(12) United States Patent
Walker et al.

US011542330B2

(10) Patent No.: US 11,542,330 B2
(45) Date of Patent: Jan. 3, 2023

(54) ANTI-CD3-BINDING DOMAINS AND ANTIBODIES COMPRISING THEM, AND METHODS FOR THEIR GENERATION AND USE

(71) Applicant: Adimab, LLC, Lebanon, NH (US)

(72) Inventors: Laura M. Walker, Lebanon, NH (US); Robert Pejchal, Lebanon, NH (US); Eric Krauland, Lebanon, NH (US); Maximiliano Vasquez, Lebanon, NH (US); Monica Wai Ling Leung, Summit, NJ (US)

(73) Assignee: Adimab, LLC, Lebanon, NH (US)

( * ) Notice: Subject to any disclaimer, the term of this patent is extended or adjusted under 35 U.S.C. 154(b) by 117 days.

(21) Appl. No.: 16/611,832

(22) PCT Filed: May 8, 2018

(86) PCT No.: PCT/US2018/031705
§ 371 (c)(1),
(2) Date: Nov. 7, 2019

(87) PCT Pub. No.: WO2018/208864
PCT Pub. Date: Nov. 15, 2018

(65) Prior Publication Data
US 2020/0190189 A1    Jun. 18, 2020

Related U.S. Application Data

(60) Provisional application No. 62/503,315, filed on May 8, 2017.

(51) Int. Cl.
*C07K 16/28* (2006.01)
(52) U.S. Cl.
CPC ...... *C07K 16/2809* (2013.01); *C07K 2317/24* (2013.01); *C07K 2317/31* (2013.01); *C07K 2317/55* (2013.01); *C07K 2317/565* (2013.01); *C07K 2317/622* (2013.01); *C07K 2317/73* (2013.01); *C07K 2317/75* (2013.01); *C07K 2317/92* (2013.01)

(58) Field of Classification Search
None
See application file for complete search history.

(56) References Cited

U.S. PATENT DOCUMENTS

| 7,728,114 B2 | 6/2010 | Mach et al. |
| 2015/0166661 A1 | 6/2015 | Chen et al. |

FOREIGN PATENT DOCUMENTS

| WO | 2004106380 | 12/2004 |
| WO | 2012158818 | 11/2012 |
| WO | 2013049254 | 4/2013 |
| WO | 2015095392 | 6/2015 |
| WO | 2016180721 | 11/2016 |

OTHER PUBLICATIONS

Vajdos et al. (J Mol Biol. Jul. 5, 2002;320(2):415-28). (Year: 2002).*
Bedouelle et al. (FEBS J. Jan. 2006;273(1):34-46). (Year: 2006).*
Brown et al. (J Immunol. May 1, 1996; 156(9):3285-91). (Year: 1996).*
Rudikoff et al. (Proc. Natl. Acad. Sci. USA, 79: 1979-1983, Mar. 1982). (Year: 1982).*
Colman (Research in Immunology, 145:33-36, 1994). (Year: 1994).*
Carpenter, Paul A et al. "A humanized non-FcR-binding anti-CD3 antibody, visilizumab, for treatment of steroid-refractory acute graft-versus-host disease." Blood vol. 99,8 (2002): 2712-9. doi:10.1182/blood.v99.8.2712.
Chatenoud, L et al. "Anti-CD3 antibody induces long-term remission of overt autoimmunity in nonobese diabetic mice." Proceedings of the National Academy of Sciences of the United States of America vol. 91,1 (1994): 123-7. doi:10.1073/pnas.91.1.123.

* cited by examiner

*Primary Examiner* — Zachary S Skelding
(74) *Attorney, Agent, or Firm* — Robin L. Teskin; Baker, Donelson, Bearman, Caldwell & Berkowitz PC

(57) ABSTRACT

Anti-CD3 binding domains and antibodies comprising them, including multispecific antibodies, with, inter alia, desirable T-cell activation and (re)directed target cell killing potency and developability, profiles are provided, as well as methods for their identification, isolation, and generation, and methods for their preparation and use. Reagents for identifying, isolating, selecting, generating and characterizing CD3 binding domains and antibodies comprising them are also provided.

19 Claims, 77 Drawing Sheets
Specification includes a Sequence Listing.

Immunization Strategy

| Primary Immunization | 1st Boost | 2nd Boost | 3rd Boost | Sac |
|---|---|---|---|---|
| 28 Days | 28 Days | 42 Days | 7 Days | |

Primary Immunization: $1.0 \times 10^6$ Purified Human T Cells with Sigma Adjuvant in Each of 10 mice 1st Boost: $1.0 \times 10^6$ Purified Human T Cells with Sigma Adjuvant in Each of 10 Mice 2nd Boost: $1.5 \times 10^6$ Purified T Cells with Sigma Adjuvant; 5 of the Mice with Human T Cells, the other 5 Mice with Cynomolgus T-Cells 3rd Boost: 50 ug Denatured Cyno CD3 Protein Mixed with 7 ug N-terminal Peptide-BSA

Figure 1

| Clone ID | VH Germ line | VH CDR1 | VH CDR2 | VH FR3 | VH CDR3 | VL Germ line | VL CDR3 |
|---|---|---|---|---|---|---|---|
| Clones with Related Sequences Comprise ~85% of the Binding Response ||||||||
| ADI-29538 | V1-125B | YTFTTYYIH | WIYPGNVNAKYNEKFKG | KATLTADKSSSTAYMQLSSLTSEDSAVYFC | ARDGYYFDY | VK08-021 | KQSYNLRT |
| ADI-29535 | V1-125B | YTFTSYYIH | WIYPGNVNTKYNENFKD | KATLTADKSSSTAYMHLSSLTSEDSAVYFC | ARDDGYYFDY | VK08-021 | KQSYNLRT |
| ADI-15505 | V1-125B | YTFISYYIH | WIYPGNVNTKYNEKFKA | KATLTADKSSSTAYMQLSSLTSEDSAVYFC | ARDDNYSFAY | VK08-021 | KQSYNLRT |
| ADI-15506 | V1-125E | YAFTSYYIH | WIYLGDGSTNYNEKFKG | KTTLTADKSSSTAYMLLSSLTSEDSATYFC | ARDDSYYFDY | VK08-021 | KQSYSLRT |
| ADI-29540 | V1-125B | YTFTSYYIH | WIYPGNVNTKYNEKFKG | KATLTADKSSSTAYMQLSSLTSEDSAVYFC | ARDGDYFFDY | VK08-021 | KQSYNLRT |
| ADI-29539 | V1-125B | YTFTSYYIH | WIYPGNVNTQYNEKFKG | KATLSADKSSSTTYMQLSSLTSEDSAVYFC | ARDGDYYFDY | VK08-021 | KQSYNLRT |
| ADI-15507 | V1-125B | YTFTRYYIH | WIYPGNVNTKYNEKFKG | KATLTADKSSSTAYMQLSSLTSEDSAVYFC | ARDGDYYFDY | VK08-021 | KQSYNLRT |
| ADI-15508 | V1-125B | YTFTSYYIH | WIYPGNVNTKYNEKFKG | KATLTADTSSSTAYMQLSSLTSEDSAVYFC | ARDGDYYFDV | VK08-021 | KQSYNLRT |
| ADI-15509 | V1-125B | YTFTSYYIH | WIYPGNVNTKYNEKFKG | KATLTADKSSSTAYMQLSSLTSEDSAIYFC | ARDGNYFFDV | VK08-021 | KQSYNLRT |
| ADI-15510 | V1-125B | YTFTSYYIH | WIFPGNVNTKYNEKFKG | KATLTADKSSSTAYMQLSSLTSEDSAVYFC | ARDGNYSFAY | VK08-021 | KQSYNLRT |
| ADI-29537 | V1-125B | NTFTSSYIH | WIYPGNVNTKYNEKFKG | KATLTADKSSSTVYMQLSSLTSEDSAVYFC | ARDGSSYYFDY | VK08-021 | KQSYNLRT |
| ADI-15511 | V1-125B | YTFTSYYIH | WIYPGDGSTKYNEKFKG | KTTLTADKSSSTAYMLLSSLTSEDSAIYFC | ARDGSYYFDY | VK08-021 | KQSYSLRT |
| ADI-15512 | V1-125E | YTFTSYYIH | WIYPEDGNTKYNEKFKG | KATLTADKSSSTAYMQLSSLTSEDSAVYFC | ARDYGYYFDY | VK08-021 | KQSYNLRT |
| ADI-15515 | V1-125B | YTFTSYYIH | WIYPGDGSTKYNEKFKG | KTTLTADKSSSTAYMLLSSLTSEDSAIYFC | ARDYGYYFDY | VK08-021 | KQSYNLRT |
| ADI-15514 | V1-125E | YTFTSYYIH | WIYPGNVNTKYNEKFKG | KATLTADKSSSTAYMQLSSLTSEDSAVYFC | ARDYGYYFDY | VK08-021 | KQSYNLRT |
| ADI-15516 | V1-125B | YTFTSYYIH | WIYPGNVNTKYNEKFKG | KTTLTADKSSSTAYMHLSSLTSEDSAVYFC | ARDYGYYFDY | VK08-021 | KQSYNLRT |
| ADI-15517 | V1-125B | YTFTSYYIH | WIYPGNVNTKYNEKFKG | KATLTADKSSSTAYMQLSSLTSEDTAVYYC | ARDYGYYFGS | VK08-021 | KQSYNLRT |
| ADI-16513 | VH14-1 | FNIKDYYMH | WIDPENGNTIYDPKFQG | KASITADTSSNTAYLQLSSLTSEDTAVYYC | ARDGYARYYFDY | VK08-021 | KQSYNLRT |
| ADI-29536 | V1-125E | YTFTNYYIH | WIYPEDGNTKYNEKFKG | KTTLTADKSSSTAYMLLSSLTSEDSAVYFC | ARNNGSSYAMDY | VK08-021 | KQSYNLRT |
| ADI-29534 | V1-039A | FNIKDYYMH | WIDPENGNTIYDPKFQG | KASITADTSSNTAYLQLSSLTSEDTAVYYC | GRDGNYFFDY | VK08-021 | KQSYNLRT |
| ADI-15518 | V1-125B | YTFTSYYIH | WIYPGNVNTKYNEKFKG | KATLTADKSSSTAYMQLSSLTSEDSAVYFC | GRDYYGSYYFDN | VK08-021 | KQSYNLRT |

Figure 4B

All Cell Binders Strongly Compete with I2C

| Clone | % Reduction in Antigen Binding Relative to Antigen-only Control | |
|---|---|---|
| | OKT3 Competition* | I2C Competition* |
| ADI-15505 | -15 | 96 |
| ADI-15506 | -50 | 99 |
| ADI-15507 | -22 | 98 |
| ADI-15508 | -18 | 99 |
| ADI-15509 | -21 | 99 |
| ADI-15510 | -9 | 98 |
| ADI-15511 | -1 | 93 |
| ADI-15515 | -1 | 93 |
| ADI-15517 | -12 | 94 |
| ADI-15512 | 0 | 98 |
| ADI-15514 | -5 | 97 |
| ADI-15516 | 0 | 94 |
| ADI-15518 | -2 | 96 |
| ADI-15513 | -2 | 97 |
| I2C | -31 | 92 |
| OKT3 | 60 | 25 |

*Competition Performed on the Surface of Yeast

| Notes | Clone ID | VH Germline | VH FR1 | VH CDR1 | VH FR2 | VH CDR2 | VH FR3 |
|---|---|---|---|---|---|---|---|
| | ADI-18562 | VH1-46 | QVQLVQSGAEVKKPGASVKVSCKASG | YTFTSYYIH | WVRQAPGQGLEWMG | WIYPGDGSTKYNEKFKG | RVTMTRDTSTSTVYMELSSLRSEDTAVYYC |
| | ADI-18564 | VH1-46 | QVQLVQSGAEVKKPGASVKVSCKASG | YTFTSYYIH | WVRQAPGQGLEWIG | WIYPGDGSTKYNEKFKG | RVTMTADKSTSTAYMELSSLRSEDTAVYYC |
| | ADI-18565 | VH1-46 | QVQLVQSGAEVKKPGASVKVSCKASG | YTFTSYYIH | WVRQAPGQGLEWMG | WIYPGDGSTKYNEKFKG | RVTMTADKSTSTAYMELSSLRSEDTAVYYC |
| | ADI-18566 | VH1-46 | QVQLVQSGAEVKKPGASVKVSCKASG | YTFTSYYIH | WVRQAPGQGLEWIG | WIYPGDGSTKYNEKFKG | RTTLTADKSTSTAYMELSSLRSEDTAVYYC |
| | ADI-18567 | VH1-46 | QVQLVQSGAEVKKPGSSVKVSCKASG | YTFTSYYIH | WVRQAPGQGLEWIG | WIYPGDGSTKYNEKFKG | RTTLTADKSTSTAYMELSSLRSEDTAVYYC |
| | ADI-18568 | VH1-46 | QVQLVQSGAEVKKPGASVKVSCKASG | YTFTSYYIH | WVRQAPGQGLEWMG | WIYPGDGSTKYNEKFKG | RVTMTRDTSTSTVYMELSSLRSEDTAVYYC |
| | ADI-18570 | VH1-46 | QVQLVQSGAEVKKPGASVKVSCKASG | YTFTSYYIH | WVRQAPGQGLEWIG | WIYPGDGSTKYNEKFKG | RVTMTADKSTSTAYMELSSLRSEDTAVYYC |
| | ADI-18571 | VH1-46 | QVQLVQSGAEVKKPGASVKVSCKASG | YTFTSYYIH | WVRQAPGQGLEWIG | WIYPGDGSTKYNEKFKG | RVTMTADKSTSTAYMELSSLRSEDTAVYYC |
| | ADI-18572 | VH1-46 | QVQLVQSGAEVKKPGASVKVSCKASG | YTFTSYYIH | WVRQAPGQGLEWIG | WIYPGDGSTKYNEKFKG | RTTLTADKSTSTAYMELSSLRSEDTAVYYC |
| | ADI-18573 | VH1-46 | QVQLVQSGAEVKKPGSSVKVSCKASG | YTFTSYYIH | WVRQAPGQGLEWIG | WIYPGDGSTKYNEKFKG | RTTLTADKSTSTAYMELSSLRSEDTAVYYC |
| | ADI-18563 | VH1-69 | QVQLVQSGAEVKKPGSSVKVSCKASG | YTFTSYYIH | WVRQAPGQGLEWMG | WIYPGDGSTKYNEKFKG | RVTITADKSTSTAYMELSSLRSEDTAVYYC |
| | ADI-18569 | VH1-69 | QVQLVQSGAEVKKPGSSVKVSCKASG | YTFTSYYIH | WVRQAPGQGLEWMG | WIYPGDGSTKYNEKFKG | RVTITADKSTSTAYMELSSLRSEDTAVYYC |
| Chimeric | ADI-15512 | V1-125E | EVQLEQSGPELVKPGASVKMSCKASG | YTFTSYYIH | WVKQRPGQGLEWIG | WIYPGDGSTKYNEKFKG | KTTLTADKSSSTAYMLLSSLTSEDSAIYFC |
| | ADI-18574 | VH1-3 | QVQLVQSGAEVKKPGASVKVSCKASG | YTFTSSYIH | WVRQAPGQRLEWMG | WIYPGNVNTKYNEKFKG | RVTITRDTSASTAYMELSSLRSEDTAVYYC |
| | ADI-18575 | VH1-3 | QVQLVQSGAEVKKPGASVKVSCKASG | YTFTSSYIH | WVRQAPGQRLEWIG | WIYPGNVNTKYNEKFKG | RVTITADKSASTAYMHLSSLRSEDTAVYYC |
| | ADI-18576 | VH1-3 | QVQLVQSGAEVKKPGASVKVSCKASG | YTFTSSYIH | WVRQAPGQRLEWIG | WIYPGNVNTKYNEKFKG | RVTITADKSASTAYMELSSLRSEDTAVYYC |
| | ADI-18578 | VH1-3 | QVQLVQSGAEVKKPGASVKVSCKASG | YTFTSSYIH | WVRQAPGQGLEWIG | WIYPGNVNTKYNEKFKG | RVTMTADKSTSTAYMELSSLRSEDTAVYYC |
| | ADI-18579 | VH1-3 | QVQLVQSGAEVKKPGASVKVSCKASG | YTFTSSYIH | WVRQAPGQGLEWIG | WIYPGNVNTKYNEKFKG | RATLTADKSTSTAYMELSSLRSEDTAVYYC |
| | ADI-18580 | VH1-3 | QVQLVQSGAEVKKPGASVKVSCKASG | YTFTSSYIH | WVRQAPGQRLEWMG | WIYPGNVNTKYNEKFKG | RVTITRDTSASTAYMELSSLRSEDTAVYYC |
| | ADI-18581 | VH1-3 | QVQLVQSGAEVKKPGASVKVSCKASG | YTFTSSYIH | WVRQAPGQRLEWIG | WIYPGNVNTKYNEKFKG | RATLTADKSASTAYMHLSSLRSEDTAVYYC |
| | ADI-18582 | VH1-3 | QVQLVQSGAEVKKPGASVKVSCKASG | YTFTSSYIH | WVRQAPGQRLEWIG | WIYPGNVNTKYNEKFKG | RATLTADKSASTAYMELSSLRSEDTAVYYC |
| | ADI-18584 | VH1-3 | QVQLVQSGAEVKKPGASVKVSCKASG | YTFTSSYIH | WVRQAPGQGLEWIG | WIYPGNVNTKYNEKFKG | RVTMTADKSTSTAYMHLSSLRSEDTAVYYC |
| | ADI-18585 | VH1-3 | QVQLVQSGAEVKKPGASVKVSCKASG | YTFTSSYIH | WVRQAPGQGLEWIG | WIJPGNVNTKYNEKFKG | RATLTADKSTSTAYMHLSSLRSEDTAVYYC |
| | ADI-18577 | VH1-46 | QVQLVQSGAEVKKPGASVKVSCKASG | YTFTSSYIH | WVRQAPGQGLEWMG | WIJPGNVNTKYNEKFKG | RVTMTRDTSTSTVYMELSSLRSEDTAVYYC |
| | ADI-18583 | VH1-46 | QVQLVQSGAEVKKPGASVKVSCKASG | YTFTSSYIH | WVRQAPGQGLEWMG | WIYPGNVNTKYNEKFKG | RVTMTRDTSTSTVYMELSSLRSEDTAVYYC |
| Chimeric | ADI-15516 | V1-125B | EVQLEESGPELVRPGASVRISCKASG | YTFTSSYIH | WVKQRPGQGLEWIG | WIYPGNVNTKYNEKFKG | KATLTADKSSSTAYMHLSSLTSEDSAVYFC |
| | ADI-18588 | VH1-3 | QVQLVQSGAEVKKPGASVKVSCKASG | FNIKDYYMH | WVRQAPGQGLEWIG | WIDPENGNTIYDPKFQG | RATITADTSTNTAYMELSSLRSEDTAVYYC |
| | ADI-18589 | VH1-3 | QVQLVQSGAEVKKPGASVKVSCKASG | FNIKDYYMH | WVRQAPGQRLEWMG | WIDPPENGNTIYDPKFQG | RVTITRDTSASTAYMELSSLRSEDTAVYYC |
| | ADI-18590 | VH1-3 | QVQLVQSGAEVKKPGASVKVSCKASG | FNIKDYYMH | WVRQAPGQRLEWIG | WIDPENGNTIYDPKFQG | RVTITRDTSASTAYMELSSLRSEDTAVYYC |
| | ADI-18591 | VH1-3 | QVQLVQSGAEVKKPGASVKVSCKASG | FNIKDYYMH | WVRQAPGQRLEWIG | WIDPENGNTIYDPKFQG | RATITADTSANTAYMELSSLRSEDTAVYYC |
| | ADI-18593 | VH1-3 | QVQLVQSGAEVKKPGASVKVSCKASG | FNIKDYYMH | WVRQAPGQGLEWMG | WIDPENGNTIYDPKFQG | RATITADTSNTNTAYMELSSLRSEDTAVYYC |
| | ADI-18594 | VH1-3 | QVQLVQSGAEVKKPGASVKVSCKASG | FNIKDYYMH | WVRQAPGQRLEWMG | WIDPENGNTIYDPKFQG | RVTITRDTSASTAYMELSSLRSEDTAVYYC |
| | ADI-18595 | VH1-3 | QVQLVQSGAEVKKPGASVKVSCKASG | FNIKDYYMH | WVRQAPGQRLEWIG | WIDPENGNTIYDPKFQG | RVTITRDTSASTAYMELSSLRSEDTAVYYC |
| | ADI-18596 | VH1-3 | QVQLVQSGAEVKKPGASVKVSCKASG | FNIKDYYMH | WVRQAPGQRLEWIG | WIDPENGNTIYDPKFQG | RATITADTSANTAYMELSSLRSEDTAVYYC |
| | ADI-18597 | VH1-46 | QVQLVQSGAEVKKPGASVKVSCKASG | FNIKDYYMH | WVRQAPGQGLEWIG | WIDPENGNTIYDPKFQG | RVTMTADTSTSTSTVYMELSSLRSEDTAVYYC |
| | ADI-18592 | VH1-46 | QVQLVQSGAEVKKPGASVKVSCKASG | FNIKDYYMH | WVRQAPGQGLEWMG | WIDPENGNTIYDPKFQG | RVTMTRDTSTSTVYMELSSLRSEDTAVYYC |
| | ADI-18587 | VH1-46 | QVQLVQSGAEVKKPGASVKVSCKASG | FNIKDYYMH | WVRQAPGQGLEWIG | WIDPENGNTIYDPKFQG | RVTMTRDTSTSTVYMELSSLRSEDTAVYYC |
| | ADI-18586 | VH1-46 | QVQLVQSGAEVKKPGASVKVSCKASG | FNIKDYYMH | WVRQAPGQGLEWIG | WIDPENGNTIYDPKFQG | RVTMTRDTSTSTVYMELSSLRSEDTAVYYC |
| Chimeric | ADI-16513 | V1-039A | QVQLEQSGAELVRPGALVKLSCKASG | FNIKDYYMH | WVKQRPEQGLEWIG | WIDPENGNTIYDPKFQG | KASITADTSSNTAYLQLSSLTSEDTAVYYC |

| VH CDR3 | VL Germline | VL CDR3 |
|---|---|---|
| ARDGSYYFDY | VK4-1 | KQSYSLRT |
| ARDGSYYFDY | VK4-1 | KQSYSLRT |
| ARDGSYYFDY | VK4-1 | KQSYSLRT |
| ARDGSYYFDY | VK4-1 | KQSYSLRT |
| ARDGSYYFDY | VK4-1 | KQSYSLRT |
| ARDGSYYFDY | VK4-1 | KQSYNLRT |
| ARDGSYYFDY | VK4-1 | KQSYNLRT |
| ARDGSYYFDY | VK4-1 | KQSYNLRT |
| ARDGSYYFDY | VK4-1 | KQSYSLRT |
| ARDGSYYFDY | VK4-1 | KQSYNLRT |
| ARDGSYYFDY | VK08-021 | KQSYSLRT |
| ARDGSYYFDY | VK4-1 | KQSYSLRT |
| ARDGYYFDY | VK4-1 | KQSYSLRT |
| ARDGYYFDY | VK4-1 | KQSYSLRT |
| ARDGYYFDY | VK4-1 | KQSYSLRT |
| ARDGYYFDY | VK4-1 | KQSYNLRT |
| ARDGYYFDY | VK4-1 | KQSYSLRT |
| ARDGYYFDY | VK4-1 | KQSYNLRT |
| ARDGYYFDY | VK4-1 | KQSYNLRT |
| ARDGYYFDY | VK08-021 | KQSYSLRT |
| ARDGYARYYFDY | VK4-1 | KQSYNLRT |
| ARDGYARYYFDY | VK4-1 | KQSYSLRT |
| ARDGYARYYFDY | VK4-1 | KQSYNLRT |
| ARDGYARYYFDY | VK4-1 | KQSYSLRT |
| ARDGYARYYFDY | VK4-1 | KQSYNLRT |
| ARDGYARYYFDY | VK4-1 | KQSYNLRT |
| ARDGYARYYFDY | VK4-1 | KQSYSLRT |
| ARDGYARYYFDY | VK4-1 | KQSYNLRT |
| ARDGYARYYFDY | VK4-1 | KQSYSLRT |
| ARDGYARYYFDY | VK08-021 | KQSYNLRT |

Sequences of Humanized Clones Selected for Optimization and their Respective Parents

| | Clone ID | VH Germ line | VH FR1 | VH CDR1 | VH FR2 |
|---|---|---|---|---|---|
| Lead | ADI-18565 | VH1-46 | QVQLVQSGAEVKKPGASVKVSCKASG | YTFTSYYIH | WVRQAPGQGLEWMG |
| Parent | ADI-15512 | V1-125E | EVQLEQSGPELVKPGASVKMSCKASG | YTFTSYYIH | WVKQRPGQGLEWIG |
| Lead | ADI-18589 | VH1-3 | QVQLVQSGAEVKKPGASVKVSCKASG | FNIKDYYMH | WVRQAPGQRLEWMG |
| Lead | ADI-18590 | VH1-3 | QVQLVQSGAEVKKPGASVKVSCKASG | FNIKDYYMH | WVRQAPGQRLEWIG |
| Parent | ADI-16513 | V1-039A | QVQLEQSGAELVRPGALVKLSCKASG | FNIKDYYMH | WVKQRPEQGLEWIG |
| Lead | ADI-18576 | VH1-3 | QVQLVQSGAEVKKPGASVKVSCKASG | YTFTSSYIH | WVRQAPGQRLEWIG |
| Lead | ADI-18585 | VH1-3 | QVQLVQSGAEVKKPGASVKVSCKASG | YTFTSSYIH | WVRQAPGQGLEWIG |
| Parent | ADI-15516 | V1-125B | EVQLEESGPELVRPGASVRISCKASG | YTFTSSYIH | WVKQRPGQGLEWIG |

| | Clone ID | VL Germ line | VL FR1 | VL CDR1 |
|---|---|---|---|---|
| Lead | ADI-18565 | VK4-1 | DIVMTQSPDSLAVSLGERATINC | KSSQSLLNSRTRKNYLA |
| Parent | ADI-15512 | VK08-021 | DIQLTQSPSSLAVSAGEKVTMSC | KSSQSLLNSRTRKNYLA |
| Lead | ADI-18589 | VK4-1 | DIVMTQSPDSLAVSLGERATINC | KSSQSLLNSRTRKNYLA |
| Lead | ADI-18590 | VK4-1 | DIVMTQSPDSLAVSLGERATINC | KSSQSLLNSRTRKNYLA |
| Parent | ADI-16513 | VK08-021 | DIQLTQSPSSLAVSAGEKVTMSC | KSSQSLLNSRTRKNYLA |
| Lead | ADI-18576 | VK4-1 | DIVMTQSPDSLAVSLGERATINC | KSSQSLLNSRTRKNYLA |
| Lead | ADI-18585 | VK4-1 | DIVMTQSPDSLAVSLGERATINC | KSSQSLLNSRTRKNYLA |
| Parent | ADI-15516 | VK08-021 | DIVLTQSPSSLAVSAGEKVTMSC | KSSQSLLNSRTRKNYLA |

Figure 13

| Sequences of Humanized Clones Selected for Optimization and their Respective Parents ||||
|---|---|---|---|
| VH CDR2 | VH FR3 | VH CDR3 ||
| WIYPGDGSTKYNEKFKG | RVTMTADKSTSTAYMELSSLRSEDTAVYYC | ARDGSYYFDY ||
| WIYPGDGSTKYNEKFKG | KTTLTADKSSSTAYMLLSSLTSEDSAIYFC | ARDGSYYFDY ||
| WIDPENGNTIYDPKFQG | RVTITRDTSASTAYMELSSLRSEDTAVYYC | ARDGYARYYFDY ||
| WIDPENGNTIYDPKFQG | RVTITADTSASTAYMELSSLRSEDTAVYYC | ARDGYARYYFDY ||
| WIDPENGNTIYDPKFQG | KASITADTSSNTAYLQLSSLTSEDTAVYYC | ARDGYARYYFDY ||
| WIYPGNVNTKYNEKFKG | RVTITADKSASTAYMELSSLRSEDTAVYYC | ARDYGYYFDY ||
| WIYPGNVNTKYNEKFKG | RATLTADKSTSTAYMHLSSLRSEDTAVYYC | ARDYGYYFDY ||
| WIYPGNVNTKYNEKFKG | KATLTADKSSSTAYMHLSSLTSEDSAVYFC | ARDYGYYFDY ||

| VL FR2 | VL CDR2 | VL FR3 | VL CDR3 |
|---|---|---|---|
| WYQQKPGQPPKLLIY | WASTRES | GVPDRFSGSGSGTDFTLTISSLQAEOVAVYYC | KQSYSLRT |
| WYQQKPGQSPKLLIY | WASTRES | GVPDRFTGSGSGTDFTLTISSVQAEOLAVYYC | KQSYSLRT |
| WYQQKPGQPPKLLIY | WASTRES | GVPDRFSGSGSGTDFTLTISSLQAEDVAVYYC | KQSYSLRT |
| WYQQKPGQPPKLLIY | WASTRES | GVPDRFSGSGSGTDFTLTISSLQAEDVAVYYC | KQSYNLRT |
| WYQQKPGQSPKLLIY | WASTRES | GVPDRFTGSGSGTDFTLTISSVQAEDLAVYYC | KQSYSLRT |
| WYQQKPGQPPKLLIY | WASTRES | GVPDRFSGSGSGTDFTLTISSLQAEDVAVYYC | KQSYNLRT |
| WYQQKPGQPPKLLIY | WASTRES | GVPDRFSGSGSGTDFTLTISSLQAEDVAVYYC | KQSYNLRT |
| WYQQKAGQSPKLLIY | WASTRES | GVPDRFTGSGSGTDFTLTISSVQAEDLAVYYC | KQSYNLRT |

Figure 13 (Continued)

| Parent | Lineage | Selection Type | Theoretical Diversity | Transformation Efficiency |
|---|---|---|---|---|
| ADI-20580 | ADI-18589 | H3 Oligo Mutagenesis | $>10^4$ | $2 \times 10^6$ |

H3 NNK Diversification Scheme

DTAVYYCXXDGYARYYFDYWGQGTLVTVSS
DTAVYYCXRXGYARYYFDYWGQGTLVTVSS
DTAVYYCXRDXYARYYFDYWGQGTLVTVSS
DTAVYYCXRDGXARYYFDYWGQGTLVTVSS
DTAVYYCXRDGYXRYYFDYWGQGTLVTVSS
DTAVYYCXRDGYAXYYFDYWGQGTLVTVSS
DTAVYYCXRDGYARXYFDYWGQGTLVTVSS
DTAVYYCXRDGYARYXFDYWGQGTLVTVSS
DTAVYYCXRDGYARYYXDYWGQGTLVTVSS
DTAVYYCXRDGYARYYFXYWGQGTLVTVSS
DTAVYYCXRDGYARYYFDXWGQGTLVTVSS
DTAVYYCAXXGYARYYFDYWGQGTLVTVSS
DTAVYYCAXDXYARYYFDYWGQGTLVTVSS
DTAVYYCAXDGXARYYFDYWGQGTLVTVSS
DTAVYYCAXDGYXRYYFDYWGQGTLVTVSS
DTAVYYCAXDGYAXYYFDYWGQGTLVTVSS
DTAVYYCAXDGYARXYFDYWGQGTLVTVSS
DTAVYYCAXDGYARYXFDYWGQGTLVTVSS
DTAVYYCAXDGYARYYXDYWGQGTLVTVSS
DTAVYYCAXDGYARYYFXYWGQGTLVTVSS
DTAVYYCAXDGYARYYFDXWGQGTLVTVSS
DTAVYYCARXXYARYYFDYWGQGTLVTVSS
DTAVYYCARXGXARYYFDYWGQGTLVTVSS
DTAVYYCARXGYXRYYFDYWGQGTLVTVSS
DTAVYYCARXGYAXYYFDYWGQGTLVTVSS
DTAVYYCARXGYARXYFDYWGQGTLVTVSS
DTAVYYCARXGYARYXFDYWGQGTLVTVSS
DTAVYYCARXGYARYYXDYWGQGTLVTVSS
DTAVYYCARXGYARYYFXYWGQGTLVTVSS
DTAVYYCARXGYARYYFDXWGQGTLVTVSS
DTAVYYCARDXXARYYFDYWGQGTLVTVSS
DTAVYYCARDXYXRYYFDYWGQGTLVTVSS
DTAVYYCARDXYAXYYFDYWGQGTLVTVSS

DTAVYYCARDXYARXYFDYWGQGTLVTVSS
DTAVYYCARDXYARYXFDYWGQGTLVTVSS
DTAVYYCARDXYARYYXDYWGQGTLVTVSS
DTAVYYCARDXYARYYFXYWGQGTLVTVSS
DTAVYYCARDXYARYYFDXWGQGTLVTVSS
DTAVYYCARDGXXRYYFDYWGQGTLVTVSS
DTAVYYCARDGXAXYYFDYWGQGTLVTVSS
DTAVYYCARDGXARXYFDYWGQGTLVTVSS
DTAVYYCARDGXARYXFDYWGQGTLVTVSS
DTAVYYCARDGXARYYXDYWGQGTLVTVSS
DTAVYYCARDGXARYYFXYWGQGTLVTVSS
DTAVYYCARDGXARYYFDXWGQGTLVTVSS
DTAVYYCARDGYXXYYFDYWGQGTLVTVSS
DTAVYYCARDGYXRXYFDYWGQGTLVTVSS
DTAVYYCARDGYXRYXFDYWGQGTLVTVSS
DTAVYYCARDGYXRYYXDYWGQGTLVTVSS
DTAVYYCARDGYXRYYFXYWGQGTLVTVSS
DTAVYYCARDGYXRYYFDXWGQGTLVTVSS
DTAVYYCARDGYAXXYFDYWGQGTLVTVSS
DTAVYYCARDGYAXYXFDYWGQGTLVTVSS
DTAVYYCARDGYAXYYXDYWGQGTLVTVSS
DTAVYYCARDGYAXYYFXYWGQGTLVTVSS
DTAVYYCARDGYAXYYFDXWGQGTLVTVSS
DTAVYYCARDGYARXXFDYWGQGTLVTVSS
DTAVYYCARDGYARXYXDYWGQGTLVTVSS
DTAVYYCARDGYARXYFXYWGQGTLVTVSS
DTAVYYCARDGYARXYFDXWGQGTLVTVSS
DTAVYYCARDGYARYXXDYWGQGTLVTVSS
DTAVYYCARDGYARYXFXYWGQGTLVTVSS
DTAVYYCARDGYARYXFDXWGQGTLVTVSS
DTAVYYCARDGYARYYXXYWGQGTLVTVSS
DTAVYYCARDGYARYYXDXWGQGTLVTVSS
DTAVYYCARDGYARYYFXXWGQGTLVTVSS

Figure 19

| ADI ID | Type | H3 | Repeats | $K_D$ Cy CD3εδ Fc (M) | Jurkat CD3+ (Median MFI) | Jurkat CD3- (Median MFI) | Cy HSC-F (Median MFI) | PSR Score | Fab Tm (°C) |
|---|---|---|---|---|---|---|---|---|---|
| ADI-20580 | Parent | ARDGYARYYFDY | 50 | 3.0E-09 | 5829 | 220 | 11651 | 0.45 | N.D. |
| ADI-21959 | Progeny | ARDGYGRYYFDY | 64 | 7.8E-09 | 7735 | 159 | 11765 | 0.28 | 81.5 |
| ADI-21961 | Progeny | ARDGYARYYYDY | 32 | 4.0E-09 | 7123 | 162 | 11681 | 0.23 | 80.0 |
| ADI-21967 | Progeny | ARDGYARYFFDY | 2 | 7.9E-09 | 7227 | 147 | 11808 | 0.19 | 79.5 |
| ADI-21969 | Progeny | GSDGYARYYFDY | 1 | 1.3E-08 | 1175 | 70 | 1977 | 0.16 | 69.0 |
| ADI-21970 | Progeny | ARDGYGRYFFDY | 1 | 2.9E-09 | 7059 | 170 | 12091 | 0.29 | 81.0 |
| ADI-21960 | Progeny | ARDGYARYYFDV | 3 | N.D. | N.D. | N.D. | N.D. | N.D. | N.D. |
| ADI-21962 | Progeny | SRDGYARYYFDY | 2 | 1.2E-08 | 7072 | 137 | 11697 | 0.14 | 76.0 |
| ADI-21963 | Progeny | ARDGYARYYFDI | 1 | 6.0E-09 | 6844 | 141 | 11676 | 0.17 | 81.5 |
| ADI-21964 | Progeny | NRDGYARYYYDY | 1 | 8.6E-09 | 7354 | 148 | 12083 | 0.22 | 72.0 |
| ADI-21965 | Progeny | ARDGYGRYYFDA | 1 | 1.0E-09 | 7110 | 146 | 12038 | 0.28 | 82.0 |
| ADI-21966 | Progeny | ARDGYARYFFDN | 1 | 1.6E-09 | 6952 | 157 | 11501 | 0.20 | 77.0 |
| ADI-21968 | Progeny | ARDGYGRYYFDR | 1 | N.D. | N.D. | N.D. | N.D. | N.D. | N.D. |
| ADI-21973 | Rational | ARDGYGRYFYDY | N.A. | 3.4E-09 | 7466 | 190 | 12573 | 0.30 | 81.5 |
| ADI-21978 | Rational | ARDGYGRYFYDV | N.A. | 2.2E-09 | 7432 | 187 | 12230 | 0.29 | 81.5 |
| ADI-21974 | Rational | ARDGYGRYFFDV | N.A. | 2.7E-09 | 7268 | 170 | 11486 | 0.29 | 82.5 |
| ADI-21971 | Rational | ARDGYGRYYYDY | N.A. | 1.7E-09 | 7297 | 180 | 12398 | 0.27 | 81.5 |
| ADI-21972 | Rational | ARDGYGRYYYDV | N.A. | 3.8E-09 | 7569 | 183 | 12670 | 0.30 | 83.0 |

Figure 22

ADI-21978 Potential Degradation Motifs

| ADI ID | CDR H2 | CDR H3 | CDR L1 | Fab KD Cy CD3εδ Fc (nM) |
|---|---|---|---|---|
| ADI-21978 (ADI-22523) | WIDLENGNTIYDPKFQG | ARDGYGRYFYDV | KSSQSLLNSRTGKNYLA | 2.1 |
| ADI-23667 | WIDLENANTIYDPKFQG | ARDGYGRYFYDV | KSSQSLLNSRTGKNYLA | 2.3 |
| ADI-23668 | WIDLENGNTIYDAKFQG | ARDGYGRYFYDV | KSSQSLLNSRTGKNYLA | 1.5 |
| ADI-23669 | WIDLENGNTIYDPKFQG | ARDAYGRYFYDV | KSSQSLLNSRTGKNYLA | 4.1 |
| ADI-23660 | WIDLENGNTIYDAKFQG | ARDGYGRYFYDV | KSSQSLLNARTGKNYLA | 1.7 |

| ADI ID | CDR H2 | CDR H3 | CDR L1 | Fab KD Cy CD3εδ Fc (nM) |
|---|---|---|---|---|
| ADI-21978 (ADI-22523) | WIDLENGNTIYDPKFQG | ARDGYGRYFYDV | KSSQSLLNSRTGKNYLA | 3.4 |
| ADI-25133 | WIDLENANTIYDAKFQG | ARDAYGRYFYDV | KSSQSLLNARTGKNYLA | 4.2 |

Figure 23A

| Parent | Lineage | Selection Type | Theoretical Diversity |
|---|---|---|---|
| ADI-21978 (ADI-22523) | ADI-18589 | H3 Oligo Mutagenesus | <10^4 |

ADI-21978(ADI-22523) FR3-CDR H3-FR4

EDTAVYYCARDGYGRYFYDVWGQGTLVTVS
EDTAVYYCXRGYGRYFYDVWGQGTLVTVS
EDTAVYYCXRDYGRYFYDVWGQGTLVTVS
EDTAVYYCAXXGYGRYFYDVWGQGTLVTVS
EDTAVYYCAXDXYGRYFYDVWGQGTLVTVS
EDTAVYYCARXGYGRYFYDVWGQGTLVTVS
EDTAVYYCARXGXGRYFYDVWGQGTLVTVS
EDTAVYYCARXGYXRYFYDVWGQGTLVTVS
EDTAVYYCARXGYGXYFYDVWGQGTLVTVS
EDTAVYYCARXGYGRXFYDVWGQGTLVTVS
EDTAVYYCARXGYGRYXYDVWGQGTLVTVS
EDTAVYYCARXGYGRYFXDVWGQGTLVTVS
EDTAVYYCARXGYGRYFYXVWGQGTLVTVS
EDTAVYYCARXGYGRYFYDXWGQGTLVTVS
EDTAVYYCARDXYGRYFYDVWGQGTLVTVS
EDTAVYYCARDXXGRYFYDVWGQGTLVTVS
EDTAVYYCARDXYXRYFYDVWGQGTLVTVS
EDTAVYYCARDXYGXYFYDVWGQGTLVTVS
EDTAVYYCARDXYGRXFYDVWGQGTLVTVS
EDTAVYYCARDXYGRYXYDVWGQGTLVTVS
EDTAVYYCARDXYGRYFXDVWGQGTLVTVS
EDTAVYYCARDXYGRYFYXVWGQGTLVTVS
EDTAVYYCARDXYGRYFYDXWGQGTLVTVS

← Selection

Novel CD3 Binder ADI-21978 (ADI-22523) H3 Mutagenesis Progeny

| Clone ID | CDR H3 | KD Hu CD3εδ Fc (M) | Response Hu CD3εδ Fc |
|---|---|---|---|
| ADI-21978 | ARDGYGRYFYDV | 3.3E-09 | 0.25 |
| ADI-26907 | GRDAYGRYFYDV | 3.8E-09 | 0.18 |
| ADI-29607 | ARDAYGRYFYRV | 4.1E-09 | 0.15 |
| ADI-29608 | PRDAYGRYFYDV | 4.3E-09 | 0.20 |
| ADI-29609 | ARDAYGRYFYDG | 6.4E-09 | 0.27 |
| ADI-29610 | ARDRYGAYFYDV | 6.7E-09 | 0.26 |
| ADI-29611 | ARDRYGRYFYDV | 7.3E-09 | 0.27 |
| ADI-29613 | ARDSYGRYFYDV | 7.8E-09 | 0.28 |
| ADI-29614 | ARDVYGRYLYDV | 9.9E-09 | 0.14 |
| ADI-26912 | ARDVLGRYFYDV | 1.1E-08 | 0.18 |
| ADI-26913 | ARDQYGRYFYDV | 1.2E-08 | 0.27 |
| ADI-29617 | ARDVYRRYFYDV | 1.2E-08 | 0.15 |
| ADI-29618 | VRDLRGRYFYDV | 1.3E-08 | 0.15 |
| ADI-26916 | ARDVYGRYFYDL | 1.3E-08 | 0.22 |
| ADI-26917 | ARDAYGGYFYDV | 2.1E-08 | 0.22 |
| ADI-26918 | ARDNYGGYFYDV | 2.5E-08 | 0.17 |

Figure 24

| Parent | Type | # | KD Hu CD3εδ Fc (M) | Fold Reduction | KD Cy CD3εδ Fc (M) | Fold Reduction |
|---|---|---|---|---|---|---|
| ADI-21978 | IgG | 1 | 2.7E-09 | N/A | 1.9E-09 | N/A |
| | scFv-Fc | 15 | 5.9E-09 | 2.2 | 4.8E-09 | 2.5 |
| | scFv-Fc (DS1) | 13 | 6.0E-09 | 2.6 | 6.9E-08 | 3.6 |
| | scFv-Fc (DS2) | 1 | 7.2E-09 | 2.7 | 6.4E-09 | 3.4 |

| Developability Profile Data | | | | | |
|---|---|---|---|---|---|
| Parent | Type | # | DSF Tm (°C) | ΔTM Fab/scFv | ΔTM +/-DS |
| ADI-21978 | IgG | 1 | 82.0 | N/A | N/A |
| | scFv-Fc | 15 | 65.9 | -16.1 | N/A |
| | scFv-Fc (DS1) | 13 | 68.2 | -13.8 | +2.3 |
| | scFv-Fc (DS2) | 1 | 69.0 | -13.0 | +3.1 |

| HC Design | Germline | FR Mutations | Proteing Sequence |
|---|---|---|---|
| HuSP34-HC1 | VH3-23 | 0 | EVQLLESGGGLVQPGGSLRLSCAASGFTFNTYAMNWVRQAPGKGLEWVSRIRSKYNNYATYY ADSVKDRFTISRDNSKNTLYLQMNSLRAEDTAVYYCVRHGNFGNSYVSWFAYWGQGTLVTVSS |
| HuSP34-HC2 | VH3-23 | 3 | EVQLLESGGGLVQPGGSLRLSCAASGFTFNTYAMNWVRQAPGKGLEWVARIRSKYNNYATYY ADSVKDRFTISRDDSKSTLYLQMNSLRAEDTAVYYCVRHGNFGNSYVSWFAYWGQGTLVTVSS |
| HuSP34-HC3 | VH3-72 | 0 | EVQLVESGGGLVQPGGSLRLSCAASGFTFNTYAMNWVRQAPGKGLEWVGRIRSKYNNYATYY ADSVKDRFTISRDDSKNSLYLQMNSLKTEDTAVYYCVRHGNFGNSYVSWFAYWGQGTLVTVSS |
| HuSP34-HC4 | VH3-72 | 1 | EVQLVESGGGLVQPGGSLRLSCAASGFTFNTYAMNWVRQAPGKGLEWVARIRSKYNNYATYY ADSVKDRFTISRDDSKNSLYLQMNSLKTEDTAVYYCVRHGNFGNSYVSWFAYWGQGTLVTVSS |

| LC Design | Germline | FR Mutations | Proteing Sequence |
|---|---|---|---|
| HuSP34-LC1 | VL8-61 | 0 | QTVVTQEPSFSVSPGGTVTLTCRSSTGAVTTSNYANWYQQTPGQAPRTLIYGTNKRAPGVPDR FSGSILGNKAALTITGAQADDESDYYCALWYSNLWVFGGGTKLTVL |
| HuSP34-LC2 | VL8-61 | 1 | QTVVTQEPSFSVSPGGTVTLTCRSSTGAVTTSNYANWYQQTPGQAPRTLIGGTNKRAPGVPDR FSGSILGNKAALTITGAQADDESDYYCALWYSNLWVFGGGTKLTVL |
| HuSP34-LC3 | VL8-61 | 5 | QTVVTQEPSFSVSPGGTVTLTCRSSTGAVTTSNYANWVQQTPGQAPRGLIGGTNKRAPGVPDR FSGSILGDKAALTITGAQADDESDYYCALWYSNLWVFGGGTKLTVL |
| HuSP34-LC4 | VL7-46 | 0 | QAVVTQEPSLTVSPGGTVTLTCRSSTGAVTTSNYANWFQQKPGQAPRTLIYGTNKRAPWTPAR FSGSLLGGKAALTLSGAQPEDEAEYYCALWYSNLWVFGGGTKLTVL |
| HuSP34-LC5 | VL7-46 | 6 | QAVVTQEPSLTVSPGGTVTLTCRSSTGAVTTSNYANWVQQKPGQAPRGLIGGTNKRAPGVPAR FSGSLLGDKAALTLSGAQPEDEAEYYCALWYSNLWVFGGGTKLTVL |
| HuSP34-LC6 | VH3-15 | 0 | EIVMTQSPATLSVSPGERATLSCRSSTGAVTTSNYANWYQQKPGQAPRLLIYGTNKRAPGIPAR FSGSGSGTEFTLTISSLQSEDFAVYYCALWYSNLWVFGGGTKVEIK |
| HuSP34-LC7 | VH3-15 | 6 | EIVVTQSPATLSVSPGERATLSCRSSTGAVTTSNYANWVQQKPGQAPRGLIGGTNKRAPGVPAR FSGSGSGDEATLTISSLQSEDFAVYYCALWYSNLWVFGGGTKVEIK |

Mutations Occurring with Respect to Human Germline Highlighted in RED

Figure 27

| Type | HC | LC | ADI ID | Fab $K_D$ Hu CDεδ Fc (M) | Fab $K_D$ Cy CDεδ Fc (M) | Jurkat CD3+ 100nM Fab (MFI) | Jurkat CD3- 100nM Fab (MFI) | HSC-F 100 nM Fab (MFI) | Fab Tm (°C) | AC-SINS Δλmax (nm) | PSR Norm. MFI |
|---|---|---|---|---|---|---|---|---|---|---|---|
| ChSP34 | | | | 5.8E-09 | 8.7E-09 | 1404.9 | 77.7 | 11806.1 | 60.5 | 9.9 | 1125.3 |
| HuSP34 | HuSP34-HC3 | HuSP34-LC5 | | 3.6E-09 | 4.9E-09 | 1992.6 | 79.1 | 11843.6 | N.D. | 26.5 | 885.8 |
| | HuSP34-HC4 | HuSP34-LC7 | | 1.8E-08 | 2.1E-08 | 982.1 | 103.6 | 10735.0 | N.D. | 18.3 | N.D. |
| | HuSP34-HC2 | HuSP34-LC3 | ADI-16606 | 5.8E-09 | 8.0E-09 | 1628.9 | 80.5 | 11885.9 | 60.5 | 5.1 | 400.2 |
| | HuSP34-HC2 | HuSP34-LC5 | | 5.3E-09 | 7.5E-09 | 1918.0 | 102.2 | 12048.5 | N.D. | 12.3 | N.D. |
| | HuSP34-HC4 | HuSP34-LC5 | | 5.9E-09 | 7.1E-09 | 1713.6 | 84.0 | 11435.5 | N.D. | 20.0 | 720.1 |

Vλ Mutagenesis Thermal-pressured Output Sequencing

| Parent | VλMut | Repeats | VL-FR1 | VL-CDR L1 | VL-FR2 | VL-CDR L2 | VL-FR3 | VL-CDR L3 | VL-FR4 |
|---|---|---|---|---|---|---|---|---|---|
| ADI-16606 | Parent | 2 | QTVVTQEPSFSVSPGGTVTLTC | RSSTGAVTTSNYAN | WVQQTPGQAPRGLIG | GTNKRAP | GVPDRFSGSLLGDKAALTITGAQADDESDYYC | ALWYSNLWV | FGGGTKLTVL |
| | L95R | 20 | QTVVTQEPSFSVSPGGTVTLTC | RSSTGAVTTSNYAN | WVQQTPGQAPRGLIG | GTNKRAP | GVPDRFSGSLLGDKAALTITGAQADDESDYYC | ALWYSNRWV | FGGGTKLTVL |
| | T27A, L95R | 10 | QTVVTQEPSFSVSPGGTVTLTC | RSSAGAVTTSNYAN | WVQQTPGQAPRGLIG | GTNKRAP | GVPDRFSGSLLGDKAALTITGAQADDESDYYC | ALWYSNRWV | FGGGTKLTVL |
| | F11L, L95R | 9 | QTVVTQEPSLSVSPGGTVTLTC | RSSTGAVTTSNYAN | WVQQTPGQAPRGLIG | GTNKRAP | GVPDRFSGSLLGDKAALTITGAQADDESDYYC | ALWYSNRWV | FGGGTKLTVL |
| | R24G, L95R | 8 | QTVVTQEPSFSVSPGGTVTLTC | GSSTGAVTTSNYAN | WVQQTPGQAPRGLIG | GTNKRAP | GVPDRFSGSLLGDKAALTITGAQADDESDYYC | ALWYSNRWV | FGGGTKLTVL |
| | F11L, S93N | 6 | QTVVTQEPSLSVSPGGTVTLTC | RSSTGAVTTSNYAN | WVQQTPGQAPRGLIG | GTNKRAP | GVPDRFSGSLLGDKAALTITGAQADDESDYYC | ALWYNNLWV | FGGGTKLTVL |
| | T2A, T27I, L95R | 6 | QAVVTQEPSFSVSPGGTVTLTC | RSSIGAVTTSNYAN | WVQQTPGQAPRGLIG | GTNKRAP | GVPDRFSGSLLGDKAALTITGAQADDESDYYC | ALWYSNRWV | FGGGTKLTVL |
| | F11L | 4 | QTVVTQEPSLSVSPGGTVTLTC | RSSTGAVTTSNYAN | WVQQTPGQAPRGLIG | GTNKRAP | GVPDRFSGSLLGDKAALTITGAQADDESDYYC | ALWYSNLWV | FGGGTKLTVL |
| | F11L, R24G | 2 | QTVVTQEPSLSVSPGGTVTLTC | GSSTGAVTTSNYAN | WVQQTPGQAPRGLIG | GTNKRAP | GVPDRFSGSLLGDKAALTITGAQADDESDYYC | ALWYSNLWV | FGGGTKLTVL |
| | F11L, T74I, S84A | 2 | QTVVTQEPSLSVSPGGTVTLTC | RSSTGAVTTSNYAN | WVQQTPGQAPRGLIG | GTNKRAP | GVPDRFSGSLLGDKAALTITGAQADDESDYYC | ALWYSNLWV | FGGGTKLTVL |
| | Q1R, F11L, S93N | 2 | RTVVTQEPSLSVSPGGTVTLTC | RSSTGAVTTSNYAN | WVQQTPGQAPRGLIG | GTNKRAP | GVPDRFSGSLLGDKAALTITGAQADDESDYYC | ALWYNNLWV | FGGGTKLTVL |
| | R24G, N52D, D69G | 2 | QTVVTQEPSFSVSPGGTVTLTC | GSSTGAVTTSNYAN | WVQQTPGQAPRGLIG | GTDKRAP | GVPDRFSGSLLGDKAALTITGAQADDESDYYC | ALWYSNRWV | FGGGTKLTVL |
| | T2P | 2 | QPVVTQEPSFSVSPGGTVTLTC | RSSTGAVTTSNYAN | WVQQTPGQAPRGLIG | GTNKRAP | GVPDRFSGSLLGDKAALTITGAQADDESDYYC | ALWYSNLWV | FGGGTKLTVL |
| | T2A, L95R | 2 | QAVVTQEPSFSVSPGGTVTLTC | RSSTGAVTTSNYAN | WVQQTPGQAPRGLIG | GTNKRAP | GVPDRFSGSLLGDKAALTITGAQADDESDYYC | ALWYSNRWV | FGGGTKLTVL |
| | R24G | 2 | QTVVTQEPSFSVSPGGTVTLTC | GSSTGAVTTSNYAN | WVQQTPGQAPRGLIG | GTNKRAP | GVPDRFSGSLLGDKAALTITGAQADDESDYYC | ALWYSNLWV | FGGGTKLTVL |
| | Q1R, R24G, T74I | 1 | RTVVTQEPSLSVSPGGTVTLTC | GSSTGAVTTSNYAN | WVQQTPGQAPRGLIG | GTNKRAP | GVPDRFSGSLLGDKAALTITGAQADDESDYYC | ALWYSNLWV | FGGGTKLTVL |
| | F11L, S12A, N52D, K53Q, A72T | 1 | QTVVTQEPSLAVSPGGTVTLTC | RSSTGAVTTSNYAN | WVQQTPGQAPRGLIG | GTDQRAP | GVPDRFSGSLLGDKATLTITGAQADDESDYYC | ALWYSNLWV | FGGGTKLTVL |
| | T2A, P8Q, T27I, L95R | 1 | QAVVTQEQSFSVSPGGTVTLTC | RSSIGAVTTSNYAN | WVQQTPGQAPRGLIG | GTNKRAP | GVPDRFSGSLLGDKAALTITGAQADDESDYYC | ALWYSNRWV | FGGGTKLTVL |
| | F11L, R24G, S25P | 1 | QTVVTQEPSLSVSPGGTVTLTC | GPSTGAVTTSNYAN | WVQQTPGQAPRGLIG | GTNKRAP | GVPDRFSGSLLGDKAVLTITGVQADDESDYYC | ALWYSNLWV | FGGGTKLTVL |
| | T39A, K53Q, S84A | 1 | QTVVTQEPSFSVSPGGTVTLTC | RSSTGAVTTSNYAN | WVQAPGQAPRGLIG | GTNQRAP | GVPDRFSGSLLGDKAALIITGAQADDESDYYC | ALWYSNRWV | FGGGTKLTVL |
| | A78V, L95R | 1 | QTVVTQEPSFSVSPGGTVTLTC | RSSTGAVTTSNYAN | WVQQTPGQAPRGLIG | GTDKRAP | GVPDRFSGSLLGDKAALTITGVQADDESDYYC | ALWYSNRWV | FGGGTKLTVL |
| | N52D, A78V | 1 | QTVVTQEPSFSVSPGGTVTLTC | RSSTGAVTTSNYAN | WVQQTPGQAPRGLIG | GTDKRAP | GVPDRFSGSLLGDKAVLTITGVQADDESDYYC | ALWYSNLWV | FGGGTKLTVL |
| | A72V | 1 | QTVVTQEPSFSVSPGGTVTLTC | RSSTGAVTTSNYAN | WVQQTPGQAPRGLIG | GTNKRAP | GVPDRFSGSLLGDKAVLTITGAQADDESDYYC | ALWYSNLWV | FGGGTKLTVL |
| | S84A | 1 | QTVVTQEPSFSVSPGGTVTLTC | RSSTGAVTTSNYAN | WVQQTPGQAPRGLIG | GTNKRAP | GVPDRFSGSLLGDKAALTITGAQADDEADYYC | ALWYNNLWV | FGGGTKLTVL |
| | P8T, F11L, N52D, D81E | 1 | QTVVTQETSLSVSPGGTVTLTC | RSSTGAVTTSNYAN | WVQQTPGQAPRGLIG | GTDKRAP | GVPDRFSGSLLGDKAALTITGAQADDESDYYC | ALWYSNLWV | FGGGTKLTVL |
| | T74I, L95R | 1 | QTVVTQEPSFSVSPGGTVTLTC | RSSTGAVTTSNYAN | WVQQTPGQAPRGLIG | GTNKRAP | GVPDRFSGSLLGDKAALTITGAQADDESDYYC | ALWYSNRWV | FGGGTKLTVL |
| | R24G, T27A | 1 | QTVVTQEPSFSVSPGGTVTLTC | GSSAGAVTTSNYAN | WVQQTPGQAPRGLIG | GTNKRAP | GVPDRFSGSLLGDKAALTITGAQADDESDYYC | ALWYSNLWV | FGGGTKLTVL |
| | F11L, S84A | 1 | QTVVTQEPSLSVSPGGTVTLTC | RSSTGAVTTSNYAN | WVQQTPGQAPRGLIG | GTNKRAP | GVPDRFSGSLLGDKAALTITGAQADDEADYYC | ALWYSNLWV | FGGGTKLTVL |
| | T2P, T30bA, T39A, K53Q, S93N | 1 | QPVVTQEPSLSVSPGGTVTLTC | RSSTGAVTFASNYAN | WVQARGQAPRGLIG | GTNQRAP | GVPDRFSGSLLGDKAALTITGAQADDESDYYC | ALWYNNLWV | FGGGTKLTVL |
| | F11L, N52D, D81E | 1 | QTVVTQEPSLSVSPGGTVTLTC | RSSTGAVTTSNYAN | WVQQTPGQAPRGLIG | GTDKRAP | GVPDRFSGSLLGDKAALTITGAQAEDESDYYC | ALWYSNLWV | FGGGTKLTVL |
| | F11L, S84A, S93N | 1 | QTVVTQEPSLSVSPGGTVTLTC | RSSTGAVTTSNYAN | WVQQTPGQAPRGLIG | GTNKRAP | GVPDRFSGSLLGDKAALTITGAQADDEADYYC | ALWYNNLWV | FGGGTKLTVL |

Figure 28D

VH Mutagenesis Thermal-pressured Output Sequencing

| Parent | VHMut | Repeats | VH-FR1 | VH-CDR H1 | VH-FR2 | VH-CDR H2 | VH-FR3 | VH-CDR H3 | VH-FR4 |
|---|---|---|---|---|---|---|---|---|---|
| ADI-16606 | Parent | 78 | EVQLLESGGGLVQPGGSLRLSCAASG | FTFNTYAMN | WVRQAPGKGLEWVA | RIRSKYNNYATYYADSVKD | RFTISRDDSKSTLYLQMNSLRAEDTAVYYC | VRHGNFGNSYVSWFAY | WGQGTLVTVSS |
|  | N30D | 4 | EVQLLESGGGLVQPGGSLRLSCAASG | FTFDTYAMN | WVRQAPGKGLEWVA | RIRSKYNNYATYYADSVKD | RFTISRDDSKSTLYLQMNSLRAEDTAVYYC | VRHGNFGNSYVSWFAY | WGQGTLVTVSS |
|  | V100cI | 3 | EVQLLESGGGLVQPGGSLRLSCAASG | FTFNTYAMN | WVRQAPGKGLEWVA | RIRSKYNNYATYYADSVKD | RFTISRDDSKSTLYLQMNSLRAEDTAVYYC | VRHGNFGNSYVSIWFAY | WGQGTLVTVSS |
|  | L5S, N30S | 3 | EVQLSESGGGLVQPGGSLRLSCAASG | FTFSTYAMN | WVRQAPGKGLEWVA | RIRSKYNNYATYYADSVKD | RFTISRDDSKSTLYLQMNSLRAEDTAVYYC | VRHGNFGNSYVSWFAY | WGQGTLVTVSS |
|  | G96S | 2 | EVQLLESGGGLVQPGGSLRLSCAASG | FTFNTYAMN | WVRQAPGKGLEWVA | RIRSKYNNYATYYADSVKD | RFTISRDDSKSTLYLQMNSLRAEDTAVYYC | VRHSNFGNSYVSWFAY | WGQGTLVTVSS |
|  | V48I | 1 | EVQLLESGGGLVQPGGSLRLSCAASG | FTFNTYAMN | WVRQAPGKGLEWIA | RIRSKYNNYATYYADSVKD | RFTISRDDSKSTLYLQMNSLRAEDTAVYYC | VRHGNFGNSYVSWFAY | WGQGTLVTVSS |
|  | N82aD | 1 | EVQLLESGGGLVQPGGSLRLSCAASG | FTFNTYAMN | WVRQAPGKGLEWVA | RIRSKYNNYATYYADSVKD | RFTISRDDSKSTLYLQMDSLRAEDTAVYYC | VRHGNFGNSYVSWFAY | WGQGTLVTVSS |
|  | N54D | 1 | EVQLLESGGGLVQPGGSLRLSCAASG | FTFNTYAMN | WVRQAPGKGLEWVA | RIRSKYNDYATYYADSVKD | RFTISRDDSKSTLYLQMNSLRAEDTAVYYC | VRHGNFGNSYVSWFAY | WGQGTLVTVSS |
|  | N30D, D72N | 1 | EVQLLESGGGLVQPGGSLRLSCAASG | FTFDTYAMN | WVRQAPGKGLEWVA | RIRSKYNNYATYYADSVKD | RFTISRNDSKSTLYLQMNSLRAEDTAVYYC | VRHGNFGNSYVSWFAY | WGQGTLVTVSS |
|  | V100cS | 1 | EVQLLESGGGLVQPGGSLRLSCAASG | FTFNTYAMN | WVRQAPGKGLEWVA | RIRSKYNNYATYYADSVKD | RFTISRDDSKSTLYLQMNSLRAEDTAVYYC | VRHGNFGNSSVSWFAY | WGQGTLVTVSS |
|  | V100cH | 1 | EVQLLESGGGLVQPGGSLRLSCAASG | FTFNTYAMN | WVRQAPGKGLEWVA | RIRSKYNNYATYYADSVKD | RFTISRDDSKSTLYLQMNSLRAEDTAVYYC | VRHGNFGNSHVSWFAY | WGQGTLVTVSS |

Figure 28D (Continued)

Parents for Cycle 2 Optimization -Binding and Developability Profile Data

| Name | VH mut | Vλ mut | Fab Tm (°C) | IgG Hu CD3εδ Fc-HIS KD (M) | IgG Cy CD3εγ Fc-HIS RU (M) | Jurkat CD3+ MFI | Jurkat CD3- MFI | Jurkat FOB | Cyno HSC-F MFI |
|---|---|---|---|---|---|---|---|---|---|
| CTL-19613 | | | 67.5 | 2.1E-09 | 2.7E-09 | 5101 | 150 | 34 | 11654 |
| ADI-16606 | | | 61.5 | 3.5E-09 | 4.9E-09 | | | | |
| ADI-29601 | Parent | F11L, N52D, D81E | 66.0 | 4.5E-09 | 6.1E-09 | 5369 | 92 | 59 | 12368 |
| ADI-29602 | Parent | F11L, S84A | 66.5 | 4.0E-09 | 5.3E-09 | 5737 | 113 | 51 | 12230 |
| ADI-29603 | N30D, Y102H | Parent | 61.5 | 3.0E-09 | 3.5E-09 | | | | |

| HuSP34 ADI-21952 Potential Degradation Motifs ||||  |
|---|---|---|---|
| ADI-ID | VH FR3 | VH CDR H13 | Fab KD Hu CD3εδ-Fc (nM) | Fab KD Cy CD3εδ-Fc (nM) |
| ADI-21952 | RFTISRDDSKSTLYLQMNSLRAEDTAVYYC | VRHGNFGNGYVSWFAH | 4.5 | 3.4 |
| ADI-23633 | RFTISRDDSKSTLYLQMESLRAEDTAVYYC | VRHGNFGNGYVSWFAH | 4.2 | 4.1 |
| ADI-23634 | RFTISRDDSKSTLYLQMNSLRAEDTAVYYC | VRHGNFGNEYVSWFAH | 18.0 | 12.0 |
| ADI-23636 | RFTISRDDSKSTLYLQMNALRAEDTAVYYC | VRHGNFGNGYVSWFAH | 3.9 | 4.1 |
| ADI-23637 | RFTISRDDSKSTLYLQMNSLRAEDTAVYYC | VRHGNFGNAYVSWFAH | 21.0 | 13.0 |

Figure 31

ADI-21952 CDR H3 Designs

DTAVYYCVRHGNFGNGYVSWFAHWGQGTLV
DTAVYYCVRHGXRHGNFGXGYVSWFAHWGQGTLV
DTAVYYCVRHGXRHGNFGXGYVSWFAHWGQGTLV
DTAVYYCVXHGNFGXGYVSWFAHWGQGTLV
DTAVYYCVXHGNFGXGYVSWFAHWGQGTLV
DTAVYYCVRXGNFGXGYVSWFAHWGQGTLV
DTAVYYCVRHXNFGNXYVSWFAHWGQGTLV
DTAVYYCVRHXNFGNXYVSWFAHWGQGTLV
DTAVYYCVRHGXFGXGYVSWFAHWGQGTLV
DTAVYYCVRHGXFGNXGYVSWFAHWGQGTLV
DTAVYYCVRHGNXGXGYVSWFAHWGQGTLV
DTAVYYCVRHGNFXXGYVSWFAHWGQGTLV
DTAVYYCVRHGNFXNXYVSWFAHWGQGTLV
DTAVYYCVRHGNFGXXYVSWFAHWGQGTLV
DTAVYYCVRHGNFGXGXVSWFAHWGQGTLV
DTAVYYCVRHGNFGXGYXSWFAHWGQGTLV
DTAVYYCVRHGNFGXGYVXWFAHWGQGTLV
DTAVYYCVRHGNFGXGYVSXFAHWGQGTLV
DTAVYYCVRHGNFGXGYVSWXAHWGQGTLV
DTAVYYCVRHGNFGXGYVSWFXHWGQGTLV
DTAVYYCVRHGNFGXGYVSWFAXWGQGTLV
DTAVYYCVRHGNXXVSWFAXWGQGTLV
DTAVYYCVRHGNFGNXYXSWFAHWGQGTLV
DTAVYYCVRHGNFGNXYVXWFAHWGQGTLV
DTAVYYCVRHGNFGNXYVSXFAHWGQGTLV
DTAVYYCVRHGNFGNXYVSWXAHWGQGTLV
DTAVYYCVRHGNFGNXYVSWFXHWGQGTLV
DTAVYYCVRHGNFGNXYVSWFAXWGQGTLV
DTAVYYCVRHGNFGNFXSWFAHWGQGTLV
DTAVYYCVRHGNFGNFXSWFAXWGQGTLV

| Parent | Selection Type | Theoretical Diversity |
|---|---|---|
| ADI-21952 | H3 Oligo Mutagenesis | $<10^4$ |

Selection ↑

HuSP34 ADI-21952 H3 Mutagenesis Progeny

| Clone ID | CDR H3 | KD Hu CD3εδ Fc (M) | PSR Score |
|---|---|---|---|
| ADI-23633 | VRHGNFGNGYVSWFAH | 3.1E-09 | 0.19 |
| ADI-29716 | VRHGNFGGGYVSWFAH | 1.9E-09 | 0.21 |
| ADI-29717 | VRHGNFGNSYVSWFAH | 3.4E-09 | 0.27 |
| ADI-29718 | VRHGNFGGGYVAWFAH | 2.0E-09 | 0.19 |
| ADI-29719 | VRHGNFQGGYVSWFAH | 2.5E-09 | 0.09 |
| ADI-29720 | VRHGNVGGGYVSWFAH | 2.0E-09 | 0.00 |
| ADI-29721 | VRHDNFGAGYVSWFAH | 5.9E-09 | 0.00 |
| ADI-29722 | VRHGNFGVGYVSWFAS | 6.3E-09 | 0.00 |
| ADI-29723 | VRHGNFGNYAVSWFAH | 3.2E-09 | 0.09 |
| ADI-29724 | VRHGSFGNHTVSWFAH | 4.9E-08 | 0.00 |

Figure 32

| ADI ID | VH CDR H3 sequence | Binding and Developability Profile Data | | | | | Jurkat CD3+ median MFI |
|---|---|---|---|---|---|---|---|
| | | BiaCore Fab $K_D$ Hu CD3ed-Fc (M) Monovalent | BiaCore Fab $K_D$ Cy CD3ed-Fc (M) Monovalent | ForteBio IgG $K_D$ Hu CD3ed-Fc (M) Avid | ForteBio IgG $K_D$ Cy CD3ed-Fc (M) Avid | ForteBio IgG $K_D$ Hu CD28-Fc (M) Avid | |
| CTL-19672 | ARDGYSRYYFDY | 9.69E-10 | 1.05E-09 | 1.46E-10 | 1.39E-10 | N.B. | 5626 |
| ADI-22523 | ARDGYGRYFYDV | 1.64E-09 | 1.39E-09 | 1.83E-10 | 1.66E-10 | N.B. | 6058 |
| ADI-26906 | ARDAYGRYFYDV | 3.52E-09 | 3.34E-09 | 2.36E-10 | 1.98E-10 | N.B. | 5825 |
| ADI-26907 | GRDAYGRYFYDV | 4.46E-09 | 3.87E-09 | 2.57E-10 | 2.32E-10 | N.B. | 5937 |
| ADI-26908 | ARDAYGRYFYDV | 5.18E-09 | 4.49E-09 | 2.74E-10 | 2.32E-10 | N.B. | 5612 |
| ADI-26910 | ARDRYGAYFYDV | 7.62E-09 | 6.98E-09 | 3.07E-10 | 2.68E-10 | N.B. | 5467 |
| ADI-26913 | ARDQYGRYFYDV | 2.92E-08 | 2.72E-08 | 5.03E-10 | 4.28E-10 | N.B. | 5275 |
| ADI-26915 | ARDVLGRYFYDV | W.B. | W.B. | 1.94E-09 | 3.06E-09 | N.B. | 1310 |
| ADI-26919 | ARDAYGRYFYDV | 5.56E-08 | 4.05E-08 | 5.07E-10 | 4.40E-10 | N.B. | 4448 |
| ADI-26920 | GRDAYGRYFYDV | 5.15E-08 | 5.11E-08 | 5.86E-10 | 5.76E-10 | N.B. | 4987 |
| ADI-26921 | ARDAYGRYFYDV | 4.61E-08 | 3.84E-08 | 6.16E-10 | 5.35E-10 | N.B. | 5202 |
| ADI-26943 | ARDAYGGYFYDV | W.B. | W.B. | 4.09E-09 | 2.50E-09 | N.B. | 1083 |
| ADI-26954 | ARDNYGGYFYDV | N.B. | N.B. | N.B. | N.B. | N.B. | 31 |
| CTL-19613 | VRHGNFGNSYIYSYWAY | 1.43E-09 | 1.62E-09 | 1.67E-10 | 1.59E-10 | N.B. | 6137 |
| ADI-21952 | VRHGNFGNGYVSWFAH | 4.13E-09 | 5.04E-09 | 7.41E-10 | 7.42E-10 | N.B. | 5724 |
| ADI-26955 | VRHGNFQGGYVSWFAH | 3.28E-09 | 3.81E-09 | 2.97E-10 | 3.05E-10 | N.B. | 5200 |
| ADI-26956 | VRHGNFGGGYVSWFAW | 3.77E-09 | 4.31E-09 | 2.33E-10 | 2.34E-10 | N.B. | 5222 |
| ADI-26962 | VRHGNFGEGYVSWFAH | 2.39E-08 | 2.67E-08 | 3.94E-10 | 3.87E-10 | N.B. | 4014 |
| ADI-26978 | VRHGNFGGAYVSWFAH | 2.92E-08 | 2.93E-08 | 5.41E-10 | 5.30E-10 | N.B. | 2956 |
| ADI-26983 | VRHGNFGGGYVSWFAW | 2.03E-08 | 2.25E-08 | N.D. | N.D. | N.B. | 4513 |
| ADI-26994 | VRHGNVGGGYVSWFAH | W.B. | W.B. | 3.26E-09 | 2.23E-09 | N.B. | 750 |
| ADI-18965 | GRDWDGAIRVLDY | N.B. | N.B. | N.B. | N.B. | N.B. | 20 |

| | |
|---|---|
| CTL-19672 is 38E4 | Highlighted Mutations to ADI-22523 H3 in RED |
| CTL-19613 is I2C | Highlighted Mutations to SP34 H3 in BLUE: VRHGNFGNSYVSWFAY |
| VH1-3/VK4-1 Negative Control | |

W.B. = Weak-binder

N.B. = Non-binder

Multiple Concentration Global Fitting 100 nM IgG

N.D. = Not Determined

Figure 35A

| Cy HSC-F Median MFI | Poly-Specificity Reagent (PSR) Score (0-1) | BVP ELISA Fold Over Background (FOB) | HIC Retention Time (min) | AC-SINS ΔλMax (nm) | SEC (% mono) | Fab Tm (°C) | HEK titer (mg/L) |
|---|---|---|---|---|---|---|---|
| 12831 | 0.71 | 22.8 | 8.1 | 25.2 | 98.0 | 74.5 | 38.2 |
| 12276 | 0.40 | 13.6 | 8.3 | 19.3 | 94.8 | 74.5 | 147.4 |
| 12000 | 0.29 | 9.4 | 8.3 | 11.2 | 98.1 | 81.5 | 163.6 |
| 11751 | 0.23 | 7.4 | 8.4 | 10.4 | 98.0 | 73.5 | 204.3 |
| 11831 | 0.23 | 10.1 | 8.3 | 9.0 | 97.8 | 81.5 | 172.8 |
| 11887 | 0.30 | 5.1 | 8.3 | 8.2 | 97.9 | 81.5 | 173.4 |
| 11471 | 0.10 | 3 | 8.2 | 2.6 | 98.1 | 81.0 | 190.4 |
| 6165 | 0.00 | 1.3 | 8.2 | 0.8 | 98.1 | 79.0 | 180.3 |
| 9742 | 0.05 | 3.7 | 8.5 | 6.8 | 94.7 | 82.0 | 123.5 |
| 11962 | 0.02 | 2.9 | 8.5 | 7.0 | 97.2 | 75.5 | 93.2 |
| 11723 | 0.06 | 3.3 | 8.5 | 5.5 | 93.8 | 82.0 | 175.7 |
| 7180 | 0.00 | 1.3 | 8.8 | 0.9 | 96.7 | 75.5 | 127.6 |
| 23 | 0.00 | 1.2 | 8.6 | 0.3 | 97.6 | 79.0 | 176.6 |
| 13240 | 0.71 | 26 | 9.6 | 20.0 | 93.1 | 60.0 | 104.8 |
| 13125 | 0.43 | 14.8 | 9.8 | 7.0 | 94.9 | 72.5 | 34.1 |
| 12893 | 0.26 | 2.8 | 9.1 | 0.4 | 97.2 | 71.5 | 207.6 |
| 11775 | 0.24 | 5.8 | 9.9 | 0.3 | 97.5 | 69.5 | 136.0 |
| 12297 | 0.10 | 3.3 | 9.2 | 0.1 | 93.4 | 67.5 | 96.6 |
| 11524 | 0.10 | 5.6 | 9.2 | 0.4 | 96.2 | 69.5 | 156.4 |
| 12504 | 0.11 | N.D. | N.D. | 0.7 | 96.3 | 69.0 | 154.2 |
| 3555 | 0.10 | 1.6 | 9.1 | 0.7 | 96.3 | 70.5 | 198.5 |
| 25 | 0.14 | N.D. | 9.5 | N.D. | 97.4 | 73.0 | 69.7 |

100 nM IgG

| Clean PSR: 0.00 -0.10 | N.D. = Not Determined | Clean to Low HIC: < 10.5 min | ΔλMax < 5 nM Implies Low Self-interaction | Titer < 50 mg/L |
| Low PSR: 0.10-0.33 | Clean BVP: FOB < 2.1 Implies Clean | Medium HIC: ≥ 10.5 and < 11.5 min | ΔλMax ≥ 5 nm and < 20 nM Implies Medium Self-interaction | |
| Medium PSR: 0.33 -0.66 | Medium BVP: FOB ≥ 2.1 and < 6.5 | High HIC: ≥ 11.5 Min | ΔλMax ≥ 20 nM Implies high Self-interaction | |
| High PSR: 0.66 -1.00 | High BVP: FOB ≥ 6.5 Implies High BVP Reactivity | | | |

Figure 35A (Continued)

| Jurkat CD3+ 10nM IgG | Jurkat CD3- 10nM IgG | Jurkat FOB 10nM | Hu HER2 mono K$_D$ (M) | Hu HER2 mono RU | Hu HER2 Fc K$_D$ (M) | Hu HER2 Fc RU | Hu HER2 mono K$_D$ (M) | Hu HER2 mono RU |
|---|---|---|---|---|---|---|---|---|
| 26.8 | 34.9 | 0.8 | 9.0E-09 | 0.20 | 2.2E-09 | 0.36 | N.B. | -0.03 |
| 26.2 | 33.0 | 0.8 | 6.6E-09 | 0.17 | 9.3E-10 | 0.32 | N.B. | -0.02 |
| 25.4 | 31.0 | 0.8 | N.B. | 0.00 | N.B. | 0.03 | 8.9E-09 | 0.22 |
| 23.8 | 30.3 | 0.8 | N.B. | 0.00 | N.B. | 0.01 | 7.3E-09 | 0.27 |
| 23.5 | 29.9 | 0.8 | N.B. | 0.02 | N.B. | 0.02 | N.B. | -0.03 |
| 24.5 | 31.7 | 0.8 | N.B. | 0.01 | N.B. | 0.01 | N.B. | -0.03 |

Figure 36A (Continued)

| Hu HER2 Fc K$_D$ (M) | Hu HER2 Fc Ru | Hu HER2 mono k$_D$ (M) | Hu HER2 mono RU | Hu HER2 Fc k$_D$ (M) | Hu HER2 Fc Ru |
|---|---|---|---|---|---|
| N.B. | 0.00 | N.B. | 0.00 | N.B. | 0.00 |
| N.B. | 0.01 | N.B. | 0.01 | N.B. | 0.01 |
| 5.6E-09 | 0.40 | N.B. | 0.01 | N.B. | 0.01 |
| 2.7E-09 | 0.39 | N.B. | 0.00 | N.B. | 0.01 |
| N.B. | 0.02 | 6.7E-10 | 0.22 | N.B. | 0.02 |
| N.B. | 0.02 | 7.4E-10 | 0.24 | N.B. | 0.01 |

Figure 36A (Continued)

ANTI-CD3-BINDING DOMAINS AND ANTIBODIES COMPRISING THEM, AND METHODS FOR THEIR GENERATION AND USE

CROSS REFERENCE TO RELATED APPLICATIONS

This application claims priority to U.S. Provisional Application No. 62/503,315, filed on May 8, 2017, the entire content of which is incorporated herein by reference.

SEQUENCE LISTING

The instant application contains a Sequence Listing which has been submitted electronically in ASCII format and is hereby incorporated by reference in its entirety. Said ASCII copy, created Feb. 16, 2022, is named 1160430o001601.txt and is 3,250,734 bytes in size.

FIELD OF THE INVENTION

The invention relates, inter alia, to anti-Cluster of Differentiation 3 (CD3)-binding domains and antibodies comprising them, including multispecific and bispecific antibodies, and functional fragments thereof, and methods and reagents for their identification, isolation, preparation, and use. Reagents for identifying, isolating, selecting, generating and characterizing CD3 binding domains and antibodies comprising them are also provided.

BACKGROUND OF THE INVENTION

All references cited herein, including without limitation patents, patent applications, and non-patent references and publications referenced throughout are hereby expressly incorporated by reference in their entireties for all purposes.

The body's immune system serves as a defense against infection, injury and cancer. Two separate but interrelated systems, humoral and cellular immune systems, work together to protect the body. The humoral system is mediated by soluble factors, named antibodies, which neutralize products recognized as being foreign by the body. In contrast, the cellular system involves cells, such as T cells and macrophages, which remove and neutralize foreign invaders.

The activation of T cells is important for the stimulation of immune responses. T cells exhibit immunological specificity and direct most of the cellular immune responses. Although T cells do not secrete antibodies, they are required for the secretion of antibodies by B lymphocytes. T cell activation requires the participation of a number of cell surface molecules, such as the T cell receptor complex, and CD4 or CD8 molecules. The antigen-specific T cell receptor (TcR) is composed of a disulfide-linked heterodimer, membrane glycoprotein with chains, alpha and beta ($\alpha$ and $\beta$), or gamma and delta ($\gamma$ and $\delta$). The TcR is non-covalently linked with a complex of invariant proteins, designated CD3.

The TcR confers antigen specificity and the CD3 structures transduce activation signals to T cells. The CD3 complex contains four subunits. They can contain two zeta subunits, one epsilon subunit and either a gamma or a delta subunit. Antigen binding leads to the cross-linking and activation of the TCR complex. T-cell receptor signaling leads to T-cell activation and IL-2 production and other cytokines in a complex process.

The ligand of the TcR is the MHC-peptide complex on the surface of target cells such as virus-infected cells. After the recognition of the MHC-peptide on the target cell, T cells can have a cytotoxic or an apoptotic effect on the target cell. Especially cytotoxic T cells (CD8 positive T cells) can have advantageous effects by directly removing virus-infected cells. This arm of the cellular immune response is particularly advantageous and is important for fighting virus infections and eliminating tumor cells.

Activation of the cytotoxic T cell may occur via direct binding of the CD3 antigen without the recognition of the MHC-peptide complex by the TcR. This alternative activation route can be achieved with anti-CD3 antibodies. Non-human monoclonal antibodies have been developed against some of the CD3 chains (subunits), as exemplified by the murine antibodies OKT3, SP34, UCHT1 or 64.1. (See e.g., June, et al., J. Immunol. 136:3945-3952 (1986); Yang, et al., J. Immunol. 137:1097-1100 (1986); and Hayward, et al., Immunol. 64:87-92 (1988)). Other CD3 antibodies are disclosed, for example, in U.S. Pat. Nos. 5,585,097; 5,929,212; 5,968,509; 6,706,265; 6,750,325; 7,381,803; 7,728,114. Bispecific antibodies with CD3 binding specificity are disclosed, for example, in U.S. Pat. Nos. 7,262,276; 7,635,472; and 7,862,813.

Many of these anti-CD3 antibodies bind the epsilon chain which leads to the development of highly activated T cells. Cancer immunotherapy with ordinary monoclonal antibodies does not typically activate T-lymphocytes sufficiently so as to elicit meaningful, targeted, pharmacologic activity towards the target cell type or tissue.

The recent development and use of multispecific antibodies, such as bispecific antibodies (bsAbs), to redirect effector T cells for the targeted killing of tumor cells has shown considerable promise both pre-clinically and clinically (see, e.g., Topp et al, 2012, Blood 120:5185-87; Bargou et al, 2008, Science 321:974-77). Many of the bispecific antibodies developed to date contain a first binding site specific to CD3 for T-cell recruitment and activation, and a second binding site for a targeted disease-associated antigen, such as CD19 (Bassan, 2012, Blood 120:5094-95). The bispecific antibody is thought to bring $CD3^+$ T cells into direct contact with targeted disease cells and induce cell-mediated cytotoxicity (Bassan, 2012). Anti-CD3×anti-CD19 bispecific antibodies have been reported to produce a complete and durable molecular remission at very low concentrations in approximately 70% of adult patients with $MRD^+$ ALL (Topp et al, 2012, Blood 120:5185-87). Bispecific antibodies recognizing gliomas and the CD3 epitope on T cells have been successfully used in treating brain tumors in human patients (Nitta, et al. Lancet 1990; 355:368-371). In addition, CD3× CD20 bispecific antibodies have been produced for clinical testing (US2015/0166661 and US2017/0202194), as well as CD3×CLL-1 (US2016/0368994).

Leukocyte redirecting bsAbs are not limited to T cells. The bispecific killer engagers (BiKEs) comprising scFvs against the NK cell antigen CD16 and a tumor-associated antigen (e.g., CD19, CD22, CD33) have also shown potent anti-cancer activity (e.g., Miller, Hematology Soc Hematol Educ Program 2013:247-53). Other alternatives include trispecific killer engagers (TriKEs), such as anti-CD16×anti-CD19×anti-CD22 (Miller, 2013; Gleason et al, 2012, Mol Cancer Ther 11:2674-84). An anti-CD 16×anti-CD33 BiKE was used to treat AML and myelodysplastic syndrome (Miller, 2013; Wiernik et al, 2013, Clin Cancer Res 19:3844-55). In refractory AML, a CD16×CD33 BiTE led to potent tumor cell killing and cytokine production by NK cells. Inhibition of ADAM 17 enhanced the CD16×CD33 BiKE response (Miller, 2013). Other trispecific, trivalent constructs, for example against CD16/CD19/HLA-DR, have been reported (Schubert et al, 2012, mAbs 4:45-56).

Numerous methods to produce bispecific antibodies are known (see, e.g. U.S. Pat. No. 7,405,320). Bispecific antibodies can be produced by the quadroma method, which involves the fusion of two different hybridomas, each producing a monoclonal antibody recognizing a different antigenic site (Milstein and Cuello, Nature 1983; 305:537-540). The fused hybridomas are capable of synthesizing two different heavy chains and two different light chains, which can associate randomly to give a heterogeneous population of 10 different antibody structures of which only one of them, amounting to ⅛ of the total antibody molecules, will be bispecific, and therefore must be further purified from the other forms. Fused hybridomas are often less stable cytogenetically than the parent hybridomas, making the generation of a production cell line more problematic.

Another method for producing bispecific antibodies uses heterobifunctional cross-linkers to chemically tether two different monoclonal antibodies, so that the resulting hybrid conjugate will bind to two different targets (Staerz, et al. Nature 1985; 314:628-631; Perez, et al. Nature 1985; 316: 354-356). Bispecific antibodies generated by this approach are essentially heteroconjugates of two IgG molecules, which diffuse slowly into tissues and are rapidly removed from the circulation. Bispecific antibodies can also be produced by reduction of each of two parental monoclonal antibodies to the respective half molecules, which are then mixed and allowed to reoxidize to obtain the hybrid structure (Staerz and Bevan. Proc Natl Acad Sci USA 1986; 83: 1453-1457). An alternative approach involves chemically cross-linking two or three separately purified Fab' fragments using appropriate linkers. All these chemical methods are undesirable for commercial development due to high manufacturing cost, laborious production process, extensive purification steps, low yields (<20%), and heterogeneous products.

Discrete VH and VL domains of antibodies produced by recombinant DNA technology may pair with each other to form a dimer (recombinant Fv fragment) with binding capability (U.S. Pat. No. 4,642,334). However, such non-covalently associated molecules are not sufficiently stable under physiological conditions to be of practical use. Cognate VH and VL domains can be joined with a peptide linker of appropriate composition and length (usually consisting of more than 12 amino acid residues) to form a single-chain Fv (scFv) with binding activity. Methods of manufacturing scFv-based agents of multivalency and multispecificity by varying the linker length were disclosed in U.S. Pat. Nos. 5,844,094, 5,837,242 and WO 98/44001. Common problems that have been frequently associated with generating scFv-based agents of multivalency and multispecificity are low expression levels, heterogeneous products, instability in solution leading to aggregates, instability in serum, and impaired affinity.

Several bispecific antibodies targeting CD3 and CD19 are in various stages of development and/or have been approved as therapeutics. An scFv-based bispecific antibody construct, known as BITE® (Bispecific T-cell Engager), employs a single polypeptide containing 2 antigen-binding specificities, each contributed by a cognate VH and VL, linked in tandem via a flexible linker (see, e.g., Nagorsen et al, 2009, Leukemia & Lymphoma 50:886-91; Amann et al, 2009, J Immunother 32:453-64; Baeuerle and Reinhardt, 2009, Cancer Res 69:4941-44). Another bispecific antibody called DART® (Dual-Affinity Re-Targeting) utilizes a disulfide-stabilized diabody design (see, e.g., Moore et al., 2011, Blood 117:4542-51; Veri et al, 2010, Arthritis Rheum 62: 1933-43). Both BITE® and DART® exhibit fast blood clearance due to their small size (~55 kDa), which requires frequent administration to maintain therapeutic levels of the bispecific antibodies.

SCORPION Therapeutics (Emergent Biosolutions, Inc., Seattle, Wash.) is a platform technology combining two antigen-binding domains in a single chain protein. One binding domain is on the C-terminus and a second binding domain on the N-terminus of an effector domain base on immunoglobulin Fc regions.

Tetravalent and bispecific antibody-like proteins are DVD-Igs which are engineered from two monoclonal antibodies (Wu, C. et al., Nature Biotechnology, 25, p 1290-1297, 2007). To construct the DVD-Ig molecule, the V domains of the two mAbs are fused in tandem by a short linker (TVAAP) (SEQ ID NO: 6714) with the variable domain of the first antibody light (VL) chain at the N terminus, followed by the other antibodies VL and Ck to form the DVD-Ig protein light chain. Similarly, the variable regions of the heavy (VH) chain of the two mAbs are fused in tandem by a short linker (ASTKGP) (SEQ ID NO: 6715) with the first antibody at the N terminus, followed by the other antibody and the heavy chain constant domains to form the DVD-Ig protein heavy chain (VH1/VL1). All light chain and heavy chain constant domains are preserved in the DVD-Ig design, as they are critical for the formation of a disulfide-linked full IgG-like molecule. Cotransfection of mammalian cells with expression vectors encoding the DVD-Ig light chain and heavy chain leads to the secretion of a single species of an IgG-like molecule with molecular weight of approximately 200 kDa. This molecule has now four binding sites, 2 from each mAb.

Bispecific antibodies have shown considerable benefits over monospecific antibodies for the treatment and the detection of cancer. Broad commercial application of bispecific antibodies has been hampered by the lack of efficient/low-cost production methods, the lack of stability of bispecific polypeptides and the lack of long half-lives in humans. A large variety of methods have been developed over the last decades to produce bispecific monoclonal antibodies (BsMAB).

However, although many candidate clinical and therapeutic antibodies have been found in early discovery efforts which display exquisite selectivity and high potency towards numerous targets of interest, a large proportion of these antibodies have nonetheless subsequently been discovered through downstream development and clinical efficacy activities to suffer from undesirable characteristics such as: promiscuity of binding, polyspecific binding (also termed herein and throughout, "polyspecificity"), off-target binding; nonspecific binding; poor expression levels or profiles in eukaryotic host cells, such as mammalian host cells and yeast cells; poor chemical and physical properties, such as poor stability during storage (e.g., poor/low "shelf-life" stability), poor (low) solubility, poor (high) viscosity, propensity to aggregate, and the like; and poor clinical and biophysical profiles, such as poor pharmacokinetic profiles, poor pharmacodynamic profiles, fast or poor in vivo clearance rates, short circulation half-life, and the like; thereby requiring the termination of further therapeutic development of such candidate antibodies. Additionally, it has been observed that antibodies derived from display technologies represent a historical minority of all clinical and marketed antibodies, a trend which is believed by many to be due, at least in part, to promiscuity of binding, poor PK profiles, and poor CMC characteristics—liabilities which are further postulated to be largely due to a lack of suitable means and methods by which undevelopable antibodies may be detected and/or counter-selected against when screening for antibodies using display technologies (see, e.g., Meninger 2012; available at hyper-text transfer protocol: proteins-congress.com/wordpress/wp-content/uploads/2012/01/Trends-in-Therapeutic-Monoclonal-Antibody-Discovery-Technology.pdf).

The art has developed certain techniques and assays to assess many of the aforementioned developability characteristics for discovered antibodies in the context of downstream development activities ("post-discovery antibodies"), such as CIC, SIC, BVP-ELISA, TMA, and other assays; however, such assays are typically not amenable to their incorporation into high-throughput early polypeptide and antibody discovery platforms, such as antibody display platforms. Furthermore, assessment of these attributes typically requires milligram to gram quantities of protein, thus often imposing a de facto limitation on the number of leads that can be pragmatically considered for development, and consequently reducing the likelihood of program success. Consequently, significant resources are often expended attempting to fix poorly behaving lead candidates with few backups available in later stages of development.

In recognition of this bottleneck, considerable efforts have been made to develop assays with lower material requirements and to bring developability assessments further upstream in the development process (Esfandiary et al., 2013, Protein Eng Des Sel 26 (10): 663-670, 2013; Sathish et al., 2013, Nat Rev Drug Discov. 12(4):306-24). A number of such assays are directed at predicting antibody solubility and aggregation behavior of identified, lead candidates. Self-interaction chromatography (SIC) and cross-interaction chromatography (CIC) are column based, low-to-medium throughput assays that correlate with and thus predict antibody solubility at relatively low concentration (Ahamed et al., 2005, J Biol Chem 280(37):32090-100; Jacobs et al., Pharm Res 27:65-71, 2010; Spencer et al., Mabs 4(3)319-325, 2012). A longer retention time on such SIC or CIC columns suggests interaction with antibodies coupled to the column, and is correlated to poor solubility (Jacobs et al., 2010). Sule and co-workers reported a medium throughput gold nanoparticle assay to predict solubility at very low concentration and further broadened the assay scope to be compatible with complex cell culture media (Sule et al., Biophys J 101(7):1749-1757, 2011; Mol Pharmaceutics 10(4):1322-1331, 2013).

As mentioned above, polyspecificity is a highly undesirable property that has been linked to poor antibody pharmacokinetics (Wu et al., J Mol Biol 368:652-665, 2007; Hötzel et al., 2012, MAbs 4(6):753-760). Certain polyspecificity assays have been reported in the art to serve as medium-throughput substitutes for broad panel tissue immunohistochemistry. Wardemann and colleagues have reported an enzyme-linked immunosorbent assay (ELISA) method using LPS, Insulin, dsDNA, and ssDNA to study polyreactivity in natural antibody repertoires over the course of B-cell maturation (Wardemann et al., 2003, Science 301 (5638):1374-7). Protein biochips in which a diverse set of proteins are spotted onto an array for high-throughput ELISAs are another type of screening tool. A chip with ~400 different human proteins from Protagen (Dortmund, Germany) has been reported to compare favorably with IHC staining analysis (Lueking et al., 2008, Bio Techniques 45(4):Pi-Pv), as well as a measure of off-target binding of clinically approved TNF-alpha inhibitors (Feyen et al., Anal Bioanal Chem 391:1713-1720, 2008). More recently, Frese et al. reported on a 384-well assay that measures polyreactivity to 32 test proteins, termed Protein Panel Profiling or 3P (Frese et al., 2013, MAbs 5:2, 279-287). Using this assay, the authors showed that FDA-approved therapeutic antibodies show a highly specific profile to the 32 test proteins and apply it to screen candidates from a phage selection process. These particular polyreactivity profiling assays have not yet been correlated with downstream development issues such as solubility, expression, and stability. A recent advance in this area was reported by Hötzel et al. 2012 MAbs 4(6): 753-760), in which a baculovirus particle (BVP) ELISA was shown to predict faster antibody non-target mediated clearance in vivo, while traditional biophysical properties such as Size Exclusion Chromatography retention time, Hydrophobic Interaction Chromatography elution time, Fv charge, and pI did not (Hötzel, et al., 2012 MAbs 4(6):753-760). Recently, reagents, methods, and means to assess, predict, select and enrich for developable therapeutic antibodies, and ultimately to generate and obtain developable antibodies, for example from antibody libraries, were disclosed (see, e.g., WO2014/179363).

While the CD3-targeting approach has shown considerable promise, a common side effect of certain T-cell immunostimulatory therapies is the associated production of cytokines, often leading to toxic cytokine release syndrome (CRS), also known as cytokine storm or cytokine release crisis. Because the anti-CD3 binding domain of the bispecific antibody engages all T cells, the high cytokine-producing CD4+ T cell subset is recruited. Moreover, the CD4+ T cell subset includes regulatory T cells, whose recruitment and expansion can potentially lead to immune suppression and have a negative impact on long-term tumor suppression.

Cell proliferative disorders, such as cancer, are characterized by the uncontrolled growth of cell subpopulations. They are the leading cause of death in the developed world and the second leading cause of death in developing countries, with over 12 million new cancer cases diagnosed and 7 million cancer deaths occurring each year. The National Cancer Institute estimates that greater than half a million Americans will die of cancer in 2013, accounting for nearly one out of every four deaths in the country. As the elderly population has grown, the incidence of cancer has concurrently risen, as the probability of developing cancer is more than two-fold higher after the age of seventy. Cancer care thus represents a significant and ever-increasing societal burden. There is, therefore a need for the provision for CD3 binding domains, and antibodies comprising them (including multispecific antibodies), which display desirable developability and/or CRS risk profiles and are safe and efficacious in, for example, binding specifically to CD3 expressed on T-cells, activating T-cells, (re)-directing the activated T-cells to kill target cells, and doing this with diminished risk of eliciting cytokine release syndrome (also known as cytokine storm or cytokine release crisis).

SUMMARY OF THE INVENTION

It has now been discovered, and is disclosed herein and throughout, a large series of CD3 binding domains and antibodies comprising them, and methods of preparing and using them. Members of this large series of CD3 binding domains collectively display a broad range of desirable properties, including, e.g.; broad of affinities for CD3 epsilon; cross-reactivity towards both human CD3 ("Hu CD3") and cynomolgus CD3 ("Cy CD3"); as well as desirable developability profiles and/or cytokine release syndrome (CRS) risk profiles, which for many of the CD3 binding domains disclosed herein are observed to be superior to the developability profiles of other anti-CD3 antibodies (e.g., I2C; SP34; 38E4; CAB21609_A01, CAB21609_B01, CAB21609_C01, CAB21609_D01 as disclosed herein as well as in Yang et al., J Immunol, Vol 137, pages 1097-1100 (Aug. 4, 1986); US 2014/008295; and WO 2015/095392).

Advantageously, the CD3 binding domains may be incorporated into essentially any antibody format, including immunoglobulin formats (e.g., IgG, IgM, IgA, IgE, and isotypes thereof), and multispecific (including bispecific) formats. Exemplary multispecific formats that are amenable for incorporation of the inventive CD3 binding domains include, e.g.: Fab-Fc-scFv ("bottle-opener") (XENCOR), Mab-scFv (XENCOR), Mab-Fv (XENCOR), Dual scFv (XENCOR), central Fv (XENCOR), central scFv (XENCOR), one-arm central scFv (XENCOR), Fab-Fab (XENCOR), Fab-Fv (XENCOR), mAb-Fv (XENCOR), mAb-Fab (XENCOR), DART (MACROGENICS), BiTE (AMGEN/MICROMET), KiTE, common light chain-IgG (GENENTECH), TandAb (AFFIMED) Cross-Mab (ROCHE), SEED (EMD SERONO), BEAT (GLENMARK), TrioMab (TRION PHARMA/FRESENIUS BIOTECH), DuetMab (MEDIMMUNE), and others, as disclosed, e.g., in (WO 95/09917; WO 2008/119566; WO 2008/119567; WO2011/121110; WO 2010/037835; WO 2007/042261; WO 2007/110205; WO 2011/121110; WO 2012/055961; WO 2012/16067; WO 2016/086189; WO 2016/182751; WO 2015/006749; WO 2014/049003; WO 2013/177101; WO 2015/128509; U.S. Pat. No. 7,951,917; US 2009/0252729; US 2014/0348839; U.S. Pat. No. 7,183,076; Mazor et al., *Mabs*, Vol. 7, pages 377-389 (2015); Muda et al., *Protein Engineering, Designe, & Selection*, Vol. 24, pages 447-454 (2011); and Del Bano et al., *Antibodies*, Vol. 5, pages 1-23 (2016).

As the inventive CD3 binding domains and antibodies comprising them collectively possess a broad range of affinity for cell-surface expressed CD3 and a broad range of T-cell activation and (re)directed target cell killing potency, and are further amenable to essentially any multispecific (including bispecific) antibody format of any valency of interest, the inventive CD3 antibodies may be selected and incorporated into therapeutic molecules designed to target almost any cell type, tissue type, and physiological compartment, and thus may serve as components of therapeutic molecules designed to address almost any disease type or disease state.

In certain embodiments, the invention provides CD3 binding domains and antibodies comprising them that bind to CD3 (e.g., CD3ε and/or CD3γ).

In certain embodiments, the inventive CD3 binding domains and antibodies comprising them are provided which display an enhanced developability profile relative to other CD3 binding domains (or antibodies comprising them). In certain embodiments, the inventive CD3 binding domains and antibodies comprising them are provided which display an enhanced developability profile relative to one or more of: trastuzumab; (Herceptin®); lintuzumab; blinatumomab (Blincyto®); and Mab 364, Mab 366, Mab 367, Mab 368, Mab 369, Mab 370, or Mab 22, as provided in Table 2.

In certain embodiments, the inventive CD3 binding domains and antibodies comprising them display a developability score of: between about 0 MFI and about 500 MFI; between about 0 MFI and about 450 MFI; between about 0 MFI and about 400 MFI; between about 0 MFI and about 350 MFI; between about 0 MFI and about 300 MFI; between about 0 MFI and about 250 MFI; between about 0 MFI and about 200 MFI; between about 0 MFI and about 150 MFI; between about 0 MFI and about 100 MFI; between about 0 MFI and about 50 MFI; between about 200 MFI and about 500 MFI; between about 200 MFI and about 450 MFI; between about 200 MFI and about 400 MFI; between about 200 MFI and about 350 MFI; between about 200 MFI and about 300 MFI; between about 200 MFI and about 250 MFI; between about 100 MFI and about 450 MFI; between about 100 MFI and about 400 MFI; between about 100 MFI and about 350 MFI; between about 100 MFI and about 300 MFI; between about 100 MFI and about 250 MFI; between about 100 MFI and about 200 MFI; or between about 100 MFI and about 150 MFI.

In other embodiments, the inventive CD3 binders and antibodies comprising them display a normalized developability score of between about 0.0 and about 0.6; between about 0.0 and about 0.57; between about 0.0 and about 0.55; between about 0.0 and about 0.53; between about 0.0 and about 0.51; between about 0.0 and about 0.49; between about 0.0 and about 0.47; between about 0.0 and about 0.45; between about 0.0 and about 0.43; between about 0.0 and about 0.41; between about 0.0 and about 0.39; between about 0.0 and about 0.37; between about 0.0 and about 0.35; between about 0.0 and about 0.33; between about 0.0 and about 0.31; between about 0.0 and about 0.29; between about 0.0 and about 0.27; between about 0.0 and about 0.25; between about 0.0 and about 0.23; between about 0.0 and about 0.21; between about 0.0 and about 0.19; between about 0.0 and about 0.17; between about 0.0 and about 0.15; between about 0.0 and about 0.13; between about 0.0 and about 0.11; between about 0.0 and about 0.09; between about 0.0 and about 0.07; or between about 0.0 and about 0.05.

In certain embodiments, the developability profile and/or developability score for the inventive CD3 binders and antibodies comprising them is obtained by performing a PSR assay; an SCP assay; AS-CINS; a BVP assay; an ELISA; a DSF assay; a Tm assay; a HIC assay; a CIC assay; or combinations thereof.

In other embodiments, the inventive CD3 binding domains and antibodies comprising them elicit potent T cell activation or T cell killing while displaying a decreased propensity to elicit cytokine production to levels capable of inducing cytokine release syndrome. In certain embodiments, at least one cytokine for which cytokine production levels are measured in order to assess the propensity to elicit cytokine production levels capable of inducing cytokine release syndrome is selected from the group consisting of: Interleukin 6 (IL-6); Interleukin 12 (IL-12); tumor necrosis factor alpha (TNFa); (TGFb); Interleukin 2 (IL-2); and Interferon gamma (IFNg).

In certain embodiments, the inventive CD3 binding domains and antibodies comprising them elicit T cell activation or T cell killing while displaying a decreased propensity to elicit cytokine production to levels capable of inducing cytokine release relative to that observed one or more of: trastuzumab; (Herceptin®); lintuzumab; blinatumomab (Blincyto®); and Mab 364, Mab 366, Mab 367, Mab 368, Mab 369, Mab 370, or Mab 22, as provided in Table 2. In certain embodiments, at least one cytokine for which cytokine production levels are measured in order to assess the propensity to elicit cytokine production levels capable of inducing cytokine release syndrome is selected from the group consisting of: Interleukin 6 (IL-6); Interleukin 12 (IL-12); tumor necrosis factor alpha (TNFa); (TGFb); Interleukin 2 (IL-2); and Interferon gamma (IFNg).

In certain embodiments, the inventive CD3 binding domains and antibodies comprising them display a cytokine release syndrome risk profile that is indicative of decreased risk of eliciting cytokine release syndrome (CRS). In other embodiments, the inventive CD3 binding domains and antibodies comprising them display a cytokine release syndrome risk profile that is indicative of decreased risk of eliciting cytokine release syndrome (CRS) when compared to the cytokine release syndrome risk profile assessed for one or more of: trastuzumab; (Herceptin®); lintuzumab; blinatumomab (Blincyto®); and Mab 364, Mab 366, Mab 367, Mab 368, Mab 369, Mab 370, or Mab 22, as provided in Table 2.

In certain embodiments, the invention provides an antibody comprising a CDRH3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH3 selected from the group consisting of the CDRH3s of Mabs 1 through 21, 23 through 222, 224 through 363, and 371 through 405 as provided in Table 2; with the proviso that the CDRH3 is not 100% identical to the CDRH3 of any of Mabs 223, 364, 365, 366, 367, 368, 369, or 370 as provided in Table 2.

In certain embodiments, the invention provides an antibody comprising a CDRH2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH2 selected from the group consisting of the CDRH2s of Mabs 1 through 21, 23 through 222, 224 through 363, and 371 through 405 as provided in Table 2; with the proviso that the CDRH2 is not 100% identical to the CDRH2 of any of Mabs 223, 364, 365, 366, 367, 368, 369, or 370 as provided in Table 2.

In certain embodiments, the invention provides an antibody comprising a CDRH1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH1 selected from the group consisting of the CDRH1s of Mabs 1 through 21, 23 through 222, 224 through 363, and 371 through 405 as provided in Table 2; with the proviso that the CDRH1 is not 100% identical to the CDRH1 of any of Mabs 223, 364, 365, 366, 367, 368, 369, or 370 as provided in Table 2.

In certain embodiments, the invention provides an antibody comprising a CDRL3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL3 selected from the group consisting of the CDRL3s of Mabs 1 through 21, 23 through 222, 224 through 363, and 371 through 405 as provided in Table 2; with the proviso that the CDRL3 is not 100% identical to the CDRL3 of any of Mabs 223, 364, 365, 366, 367, 368, 369, or 370 as provided in Table 2.

In certain embodiments, the invention provides an antibody comprising a CDRL2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL2 selected from the group consisting of the CDRL2s of Mabs 1 through 21, 23 through 222, 224 through 363, and 371 through 405 as provided in Table 2; with the proviso that the CDRL2 is not 100% identical to the CDRL2 of any of Mabs 223, 364, 365, 366, 367, 368, 369, or 370 as provided in Table 2.

In certain embodiments, the invention provides an antibody comprising a CDRL1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL1 selected from the group consisting of the CDRL1s of Mabs 1 through 21, 23 through 222, 224 through 363, and 371 through 405 as provided in Table 2; with the proviso that the CDRL1 is not 100% identical to the CDRL1 of any of Mabs 223, 364, 365, 366, 367, 368, 369, or 370 as provided in Table 2.

In certain embodiments, the invention provides an antibody comprising a heavy chain (HC) that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; an HC selected from the group consisting of the HCs of Mabs 1 through 21, 23 through 222, 224 through 363, and 371 through 405 as provided in Table 2; with the proviso that the HC is not 100% identical to the HC of any of Mabs 223, 364, 365, 366, 367, 368, 369, or 370 as provided in Table 2.

In certain embodiments, the invention provides an antibody comprising a light chain (LC) that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; an LC selected from the group consisting of the LCs of Mabs 1 through 21, 23 through 222, 224 through 363, and 371 through 405 as provided in Table 2; with the proviso that the LC is not 100% identical to the LC of any of Mabs 223, 364, 365, 366, 367, 368, 369, or 370 as provided in Table 2.

In certain embodiments, the invention provides an antibody comprising a CDRH3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH3 selected from the group consisting of the CDRH3s of Mabs 1 through 21, 23 through 222, 224 through 363, and 371 through 405 as provided in Table 2; a CDRH2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH2 selected from the group consisting of the CDRH2s of Mabs 1 through 21, 23 through 222, 224 through 363, and 371 through 405 as provided in Table 2; and a CDRH1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH1 selected from the group consisting of the CDRH1s of Mabs 1 through 21, 23 through 222, 224 through 363, and 371 through 405 as provided in Table 2; with the proviso that the neither the CDRH3, CDRH2, nor the CHRH1 is 100% identical to the CHRH3, CDRH2, or CDRH1, respectively, of any of Mabs 223, 364, 365, 366, 367, 368, 369, or 370 as provided in Table 2.

In certain embodiments, the invention provides an antibody comprising a CDRL3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL3 selected from the group consisting of the CDRL3s of Mabs 1 through 21, 23 through 222, 224 through 363, and 371 through 405 as provided in Table 2; a CDRL2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL2 selected from the group consisting of the CDRL2s of Mabs 1 through 21, 23 through 222, 224 through 363, and 371 through 405 as provided in Table 2; and a CDRL1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical; to a CDRL1 selected from the group consisting of the CDRL1s of Mabs 1 through 21, 23 through 222, 224 through 363, and 371 through 405 as provided in Table 2; with the proviso that the neither the CDRL3, CDRL2, nor the CHRL1 is 100% identical to the CHRL3, CDRL2, or CDRL1, respectively, of any of Mabs 223, 364, 365, 366, 367, 368, 369, or 370 as provided in Table 2.

In certain embodiments, the invention provides an antibody comprising a CDRH3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH3 selected from the group consisting of the CDRH3s of Mabs 1 through 21, 23 through 222, 224 through 363, and 371 through 405 as provided in Table 2; a CDRH2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH2 selected from the group consisting of the CDRH2s of Mabs 1 through 21, 23 through 222, 224 through 363, and 371 through 405 as provided in Table 2; a CDRH1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH1 selected from the group consisting of the CDRH1s of Mabs 1 through 21, 23 through 222, 224 through 363, and 371 through 405 as provided in Table 2; a CDRL3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL3 selected from the group consisting of the CDRL3s of Mabs 1 through 21, 23 through 222, 224 through 363, and 371 through 405 as provided in Table 2; a CDRL2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL2 selected from the group consisting of the CDRL2s of Mabs 1 through 21, 23 through 222, 224 through 363, and 371 through 405 as provided in Table 2; and a CDRL1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL1 selected from the group consisting of the CDRL1s of Mabs 1 through 21, 23 through 222, 224 through 363, and 371 through 405 as provided in Table 2; with the proviso that the neither the CDRH3, CDRH2, CDRH1, CDRL3, CDHL2, nor the CHRL1 is 100% identical to the CHRH3, CDRH2, CDRH1, CDRL3, CDHL2, or the CDRL1, respectively, of any of Mabs 223, 364, 365, 366, 367, 368, 369, or 370 as provided in Table 2.

In certain embodiments, the invention provides an antibody comprising a CD3 binding domain selected from the group consisting of: the CD3 binding domains of ADI-15512; ADI-15516; and ADI-16513; as provided in Table 2.

In certain embodiments, the invention provides an antibody comprising a CD3 binding domain selected from the group consisting of: the CD3 binding domains of ADI-18562; ADI-18564; ADI-18565; ADI-18566; ADI-18567; ADI-18568; ADI-18570; ADI-18571; ADI-18572; ADI-18573; ADI-18563; ADI-18569; ADI-18574; ADI-18575; ADI-18576; ADI-18578; ADI-18579; ADI-18580; ADI-18581; ADI-18582; ADI-18584; ADI-18585; ADI-18577; ADI-18583; ADI-18588; ADI-18589; ADI-18590; ADI-18591; ADI-18593; ADI-18594; ADI-18595; ADI-18596; ADI-18597; ADI-18592; ADI-18587; ADI-18586; and; ADI-16606; as provided in Table 2.

In certain embodiments, the invention provides an antibody comprising a CD3 binding domain selected from the group consisting of: the CD3 binding domains of ADI-18576; ADI-20820; ADI-20578; ADI-20571; ADI-21097; ADI-20577; ADI-20576; ADI-20568; ADI-20582; ADI-20575; ADI-20567; ADI-20574; ADI-20573; ADI-20579; ADI-18565; ADI-20818; ADI-20587; ADI-20588; ADI-20589; ADI-20590; ADI-20594; ADI-20596; ADI-20599; ADI-20605; ADI-20607; ADI-20608; and ADI-20609; as provided in Table 2.

In certain embodiments, the invention provides an antibody comprising a CD3 binding domain selected from the group consisting of: the CD3 binding domains of ADI-16606; ADI-20587; ADI-20607; ADI-20590; ADI-28708; ADI-28709; ADI-28710; ADI-21943; ADI-28711; ADI-28712; ADI-28713; ADI-28714; ADI-28715; ADI-21944; ADI-28716; ADI-21945; ADI-21946; ADI-28717; ADI-21947; ADI-28718; ADI-28719; ADI-28720; ADI-28721; ADI-28722; ADI-28723; ADI-28724; ADI-28725; ADI-28726; ADI-28727; ADI-28728; ADI-28729; ADI-28730; ADI-28731; ADI-28732; ADI-28733; ADI-28734; ADI-28735; ADI-28736; ADI-28737; ADI-28738; ADI-28739; ADI-28740; ADI-28741; ADI-28742; ADI-28743; ADI-21948; ADI-21949; ADI-28744; ADI-21950; ADI-28745; ADI-28746; ADI-28747; ADI-28748; ADI-21951; ADI-21952; ADI-28749; ADI-28750; ADI-28751; ADI-21953; ADI-28752; ADI-21954; ADI-28753; ADI-28754; ADI-28755; ADI-28756; ADI-28757; ADI-28758; ADI-28759; ADI-28760; ADI-28761; ADI-28762; ADI-28763; ADI-28764; ADI-28765; ADI-28766; ADI-28767; ADI-28768; ADI-21955; ADI-28769; ADI-28770; ADI-21956; ADI-28771; ADI-28772; ADI-28773; ADI-28774; and ADI-28775; as provided in Table 2.

In certain embodiments, the invention provides an antibody comprising a CD3 binding domain selected from the group consisting of: the CD3 binding domains of ADI-21959; ADI-21963; ADI-21965; ADI-21967; ADI-21970; ADI-21971; ADI-21972; ADI-21973; ADI-21974; ADI-21975; ADI-21976; ADI-21977; ADI-21978; ADI-21979; ADI-21943; ADI-21944; ADI-21945; ADI-21946; ADI-21947; ADI-21948; ADI-21949; ADI-21950; ADI-21951; ADI-21952; ADI-21953; ADI-21954; ADI-21955; and ADI-21956; as provided in Table 2.

In certain embodiments, the invention provides an antibody comprising a CD3 binding domain selected from the group consisting of: the CD3 binding domains of ADI-21952; ADI-22523; ADI-24403; ADI-24404; ADI-24405; ADI-24407; ADI-24408; ADI-24409; ADI-24410; ADI-24411; ADI-24412; ADI-24413; ADI-24414; ADI-24415; ADI-24416; ADI-24417; ADI-24418; ADI-24434; ADI-24435; ADI-24436; ADI-24437; ADI-24438; ADI-24439; ADI-24440; ADI-24441; ADI-24442; ADI-24443; ADI-24444; ADI-24445; ADI-24446; ADI-24449; ADI-24388; ADI-24389; ADI-24390; ADI-24391; ADI-24392; ADI-24393; ADI-24394; ADI-24395; ADI-24396; ADI-24397; ADI-24398; ADI-24399; ADI-24400; ADI-24401; ADI-24402; ADI-24419; ADI-24420; ADI-24421; ADI-24422; ADI-24423; ADI-24424; ADI-24425; ADI-24426; ADI-24427; ADI-24428; ADI-24429; ADI-24430; ADI-24431; ADI-24432; ADI-24433; ADI-24447; and ADI-24448; as provided in Table 2.

In certain embodiments, the invention provides an antibody comprising a CD3 binding domain selected from the group consisting of: the CD3 binding domains of ADI-22523; ADI-23652; ADI-23653; ADI-23654; ADI-23655; ADI-23656; ADI-23657; ADI-23658; ADI-23651; ADI-23644; ADI-23645; ADI-23646; ADI-23647; ADI-23648; ADI-23649; ADI-23650; ADI-23667; ADI-23668; ADI-23669; ADI-23670; ADI-23671; ADI-23672; ADI-23673; ADI-23659; ADI-23660; ADI-23661; ADI-23663; ADI-23664; ADI-23639; ADI-23641; ADI-23642; ADI-23640; ADI-23643; ADI-21952; ADI-23633; ADI-23634; ADI-23635; ADI-23636; ADI-23637; ADI-23638; ADI-23632; and ADI-23629; as provided in Table 2.

In certain embodiments, the invention provides an antibody comprising a CD3 binding domain selected from the group consisting of: the CD3 binding domains of ADI-22523; ADI-26906; ADI-26907; ADI-26908; ADI-26909; ADI-26910; ADI-26912; ADI-26913; ADI-26915; ADI-26916; ADI-26917; ADI-26918; ADI-26919; ADI-26920; ADI-26921; ADI-26924; ADI-26925; ADI-26927; ADI-26928; ADI-26929; ADI-26930; ADI-26932; ADI-26933; ADI-26938; ADI-26939; ADI-26940; ADI-26941; ADI-26942; ADI-26943; ADI-26944; ADI-26945; ADI-26950; ADI-26954; ADI-23672; ADI-23673; ADI-23664; ADI-26955; ADI-26956; ADI-26957; ADI-26958; ADI-26959; ADI-26960; ADI-26962; ADI-26963; ADI-26964; ADI-26965; ADI-26966; ADI-26968; ADI-26969; ADI-26971;

ADI-26972; ADI-26973; ADI-26974; ADI-26975; ADI-26976; ADI-26977; ADI-26978; ADI-26979; ADI-26980; ADI-26981; ADI-26982; ADI-26983; ADI-26984; ADI-26985; ADI-26986; ADI-26987; ADI-26988; ADI-26989; ADI-26990; ADI-26991; ADI-26992; ADI-26993; ADI-26994; and ADI-26995; as provided in Table 2.

In certain embodiments, the invention provides an antibody comprising a CD3 binding domain selected from the group consisting of: the CD3 binding domains of ADI-22523; ADI-26906; ADI-26907; ADI-26908; ADI-26910; ADI-26913; ADI-26915; ADI-26919; ADI-26920; ADI-26921; ADI-26943; ADI-26954; ADI-21952; ADI-26955; ADI-26956; ADI-26962; ADI-26978; ADI-26983; and ADI-26994; as provided in Table 2.

In certain embodiments, the invention provides an antibody comprising a CD3 binding domain selected from the group consisting of: ADI-15512; ADI-16513; ADI-15516; ADI-18565; ADI-18589; ADI-18585; ADI-18590; ADI-18576; ADI-20568; ADI-20580; ADI-21978; ADI-22523; ADI-25133; and ADI-26906.

In certain embodiments, the invention provides an antibody comprising a CD3 binding domain selected from the group consisting of: ADI-16606; ADI-29601; ADI-29602; ADI-29603; ADI-20587; ADI-20607; ADI-20590; ADI-21952; ADI-23633; ADI-26955; ADI-26956; ADI-26957; ADI-26958; ADI-26959; ADI-26960; ADI-26961; ADI-26962; ADI-26963; ADI-26964; ADI-26965; ADI-26966; ADI-26967; ADI-26968; ADI-26969; ADI-26970; ADI-26971; ADI-26972; ADI-26973; ADI-26974; ADI-26975; ADI-26976; ADI-26977; ADI-26978; ADI-26979; ADI-26980; ADI-26981; ADI-26982; ADI-26983; ADI-26984; ADI-26985; ADI-26986; ADI-26987; ADI-26988; ADI-26989; ADI-26990; ADI-26991; ADI-26992; ADI-26993; and ADI-26994.

In certain embodiments either alone or in combination with other embodiments of the invention, the inventive CD3 binding domains and antibodies comprising them display a decreased propensity for degradation relative to one or more of: trastuzumab; (Herceptin®); lintuzumab; blinatumomab (Blincyto®); and Mab 364, Mab 366, Mab 367, Mab 368, Mab 369, Mab 370, or Mab 22, as provided in Table 2.

In certain embodiments either alone or in combination with other embodiments of the invention, the inventive CD3 binding domains and antibodies comprising them display a decreased CRS risk profile relative to one or more of: trastuzumab; (Herceptin®); lintuzumab; blinatumomab (Blincyto®); and Mab 364, Mab 366, Mab 367, Mab 368, Mab 369, Mab 370, or Mab 22, as provided in Table 2.

In certain embodiments either alone or in combination with other embodiments, provided are CD3 binding domains and antibodies comprising them display a decreased propensity for degradation relative to one or more of: trastuzumab; (Herceptin®); lintuzumab; blinatumomab (Blincyto®); and Mab 364, Mab 366, Mab 367, Mab 368, Mab 369, Mab 370, or Mab 22, as provided in Table 2.

In certain embodiments and/or in combination with any of the embodiments disclosed herein and throughout, provided are CD3 binding domains and antibodies comprising them that are humanized. In certain embodiments, such CD3 binding domains comprise CDRs of such other embodiments, and further comprise an acceptor human framework, e.g., a human immunoglobulin framework or a human consensus framework.

In certain embodiments and/or in combination with any of the embodiments disclosed herein and throughout provided are CD3 binding domains and antibodies comprising them comprising a VH as in any of the embodiments provided herein and throughout, and a VL as in any of the embodiments provided herein and throughout, wherein one or both of the variable domain sequences include post-translational modifications.

In a further aspect of the invention, provided are CD3 binding domains and antibodies comprising them that bind to the same epitope as a CD3 binding domain provided in the other embodiments disclosed therein and throughout.

In certain embodiments, CD3 binding domains and/or antibodies comprising them have a CD3 dissociation constant (Kd) of ≤1 µM, ≤100 nM, ≤10 nM, ≤1 nM, ≤0.1 nM, ≤0.01 nM, or ≤0.001 nM (e.g., $10^{-8}$M or less, e.g., from $10^{-8}$M to $10^{-13}$M, e.g., from $10^{-9}$M to $10^{-13}$ M).

In a further aspect of the invention, CD3 binding domains and antibodies comprising them comprise a multispecific antibody. In a further aspect of the invention, CD3 binding domains and antibodies comprising them comprise a bispecific antibody.

In a further aspect of the invention, CD3 binding domains and antibodies comprising them comprise at least a second antigen binding domain that specifically binds to an oncology target; an immune-oncology target; a neurodegenerative disease target; an autoimmune disorder target; an infectious disease target; a metabolic disease target; a cognitive disorder target; a blood-brain barrier target; or a blood disease target.

In certain embodiments, the inventive CD3 binding domains and antibodies comprising them comprise a multispecific antibody, for example, a bispecific antibody wherein the multispecific antibody comprises a second binding domain having specificity for a second antigen selected from the group consisting of: 0772P (CA125, MUC16; Genbank accession no. AF36148); adipophilin (perilipin-2, Adipose differentiation-related protein, ADRP, ADFP, MGC10598; NCBI Reference Sequence: NP-001113.2); AIM-2 (Absent In Melanoma 2, PYHIN4, Interferon-Inducible Protein AIM2; NCBI Reference Sequence: NP-004824.1); ALDH1 A1 (Aldehyde Dehydrogenase 1 Family, Member A1, ALDH1, PUMB 1, Retinaldehyde Dehydrogenase 1, ALDC, ALDH-E1, ALHDII, RALDH 1, EC 1.2.1.36, ALDH11, HEL-9, HEL-S-53e, HEL12, RALDH1, Acetaldehyde Dehydrogenase 1, Aldehyde Dehydrogenase 1, Soluble, Aldehyde Dehydrogenase, Liver Cytosolic, ALDH Class 1, Epididymis Luminal Protein 12, Epididymis Luminal Protein 9, Epididymis Secretory Sperm Binding Protein Li 53e, Retinal Dehydrogenase 1, RaIDH1, Aldehyde Dehydrogenase Family 1 Member A1, Aldehyde Dehydrogenase, Cytosolic, EC 1.2.1; NCBI Reference Sequence: NP-000680.2); alpha-actinin-4 (ACTN4, Actinin, Alpha 4, FSGS1, Focal Segmental Glomerulosclerosis 1, Non-Muscle Alpha-Actinin 4, F-Actin Cross-Linking Protein, FSGS, ACTININ-4, Actinin Alpha4 Isoform, alpha-actinin-4; NCBI Reference Sequence: NP-004915.2); alpha-fetoprotein (AFP, HPAFP, FETA, alpha-1-fetoprotein, alpha-fetoglobulin, Alpha-1-fetoprotein, Alpha-fetoglobulin, HP; GenBank: AAB58754.1); Amphiregulin (AREG, SDGF, Schwannoma-Derived Growth Factor, Colorectum Cell-Derived Growth Factor, AR, CRDGF; GenBank: AAA51781.1); ARTC1 (ART1, ADP-Ribosyltransferase 1, Mono(ADP-Ribosyl)Transferase 1, ADP-Ribosyltransferase C2 And C3 Toxin-Like 1, ART2, CD296, RT6, ADP-Ribosyltransferase 2, GPI-Linked NAD(P)(+)-Arginine ADP-Ribosyltransferase 1, EC 2.4.2.31, CD296 Antigen; NP); ASLG659; ASPHDI (Aspartate Beta-Hydroxylase Domain Containing 1, Aspartate Beta-Hydroxylase Domain-Containing Protein 1, EC 1.14.11, GenBank: AAI44153.1); B7-H4 (VTCN1, V-Set Domain Containing T Cell Activation Inhibitor 1, B7H4, B7 Superfamily Member 1, Immune Costimulatory Protein B7-H4, B7h.5, T-Cell Costimulatory Molecule B7x, B7S1, B7X, VCTN1, H4, B7 Family Member, PRO1291, B7 Family Member, H4, T Cell Costimulatory Molecule B7x, V-Set Domain-Containing T-Cell Activation Inhibitor 1, Protein B7S1; GenBank: AAZ 17406.1); BAFF-R (TNFRSF13C, Tumor Necrosis Factor Receptor Superfamily, Member 13C, BAFFR, B-Cell-Activating Factor Receptor, BAFF Receptor, BLyS Receptor 3, CVID4, BROMIX, CD268, B Cell-Activating Factor Receptor, prolixin, Tumor Necrosis Factor Receptor Superfamily Member 13C, BR3, CD268 Antigen; NCBI Reference Sequence: NP-443177.1); BAGE-1; BCLX (L); BCR-ABL fusion protein (b3a2); beta-catenin (CTNNB1, Catenin (Cadherin-Associated Protein), Beta 1, 88 kDa, CTNNB, MRD19, Catenin (Cadherin-Associated Protein), Beta 1 (88 kD), armadillo, Catenin Beta-1; GenBank: CAA61107.1); BING-4 (WDR46, WD Repeat Domain 46, C6orf11, BING4, WD Repeat-Containing Protein BING4, Chromosome 6 Open Reading Frame 11, FP221, UTP7, WD Repeat-Containing Protein 46; NP); BMPR1 B (bone morphogenetic protein receptor-type IB, Genbank accession no. NM-00120; NP); B-RAF (Brevican (BCAN, BEHAB, Genbank accession no. AF22905); Brevican (BCAN, Chondroitin Sulfate Proteoglycan 7, Brain-Enriched Hyaluronan-Binding Protein, BEHAB, CSPG7, Brevican Proteoglycan, Brevican Core Protein, Chondroitin Sulfate Proteoglycan BEHAB; GenBank: AAH27971.1); CALCA (Calcitonin-Related Polypeptide Alpha, CALC1, Calcitonin 1, calcitonin, Alpha-Type CGRP, Calcitonin Gene-Related Peptide I, CGRP-I, CGRP, CGRP1, CT, KC, Calcitonin/Calcitonin-Related Polypeptide, Alpha, katacalcin; NP); CASP-5 (CASP5, Caspase 5, Apoptosis-Related Cysteine Peptidase, Caspase 5, Apoptosis-Related Cysteine Protease, Protease ICH-3, Protease TY, ICE(rel)-111, ICE(rel)III, ICEREL-III, ICH-3, caspase-5, TY Protease, EC 3.4.22.58, ICH3, EC 3.4.22; NP); CASP-8; CD19 (CD19-B-lymphocyte antigen CD19 isoform 2 precursor, B4, CVID3 [*Homo sapiens*], NCBI Reference Sequence: NP-001761.3); CD20 (CD20-B-lymphocyte antigen CD20, membrane-spanning 4-domains, subfamily A, member 1, B1, Bp35, CD20, CVID5, LEU-16, MS4A2, S7; NCBI Reference Sequence: NP-690605.1); CD21 (CD21 (CR2 (Complement receptor or C3DR (C3d/Epstein Barr virus receptor) or Hs.73792 Genbank accession no. M2600); (CD22 (B-cell receptor CD22-B isoform, BL-CAM, Lyb-8, LybB, SIGLEC-2, FLJ22814, Genbank accession No. AK02646); CD22; CD33 (CD33 Molecule, CD33 Antigen (Gp67), Sialic Acid Binding Ig-Like Lectin 3, Sialic Acid-Binding Ig-Like Lectin 3, SIGLEC3, gp67, SIGLEC-3, Myeloid Cell Surface Antigen CD33, p67, Siglec-3, CD33 Antigen; GenBank: AAH28152.1); CD45; CD70 (CD70-tumor necrosis factor (ligand) superfamily, member 7; surface antigen CD70; Ki-24 antigen; CD27 ligand; CD27-L; tumor necrosis factor ligand superfamily member 7; NCBI Reference Sequence for species *Homo sapiens*: NP-001243.1); CD72 (CD72 (B-cell differentiation antigen CD72, Lyb-; 359 aa, μl: 8.66, MW: 40225, TM: 1 [P] Gene Chromosome: 9p13.3, Genbank accession No. NP-001773.); CD79a (CD79a (CD79A, CD79a, immunoglobulin-associated alpha, a B cell-specific protein that covalently interacts with Ig beta (CD79B) and forms a complex on the surface with Ig M molecules, transduces a signal involved in B-cell differentiation), al: 4.84, MW: 25028 TM: 2 [P] Gene Chromosome: 19q13.2, Genbank accession No. NP-001774.1); CD79b (CD79b (CD79B, CD79b, IGb (immunoglobulin-associated beta), B29, Genbank accession no. NM-000626 or 1103867); Cdc27 (Cell Division Cycle 27, D0S1430E, D17S978E, Anaphase Promoting Complex Subunit 3, Anaphase-Promoting Complex Subunit 3, ANAPC3, APC3, CDC27Hs, H-NUC, CDC27 Homolog, Cell Division Cycle 27 Homolog (S. *Cerevisiae*), HNUC, NUC2, Anaphase-Promoting Complex, Protein 3, Cell Division Cycle 27 Homolog, Cell Division Cycle Protein 27 Homolog, Nuc2 Homolog; GenBank: AAH11656.1); CDK4 (Cyclin-Dependent Kinase 4, Cell Division Protein Kinase 4, PSK-J3, EC 2.7.11.22, CMM3, EC 2.7.11; NCBI Reference Sequence: NP-000066.1); CDKN2A (Cyclin-Dependent Kinase Inhibitor 2A, MLM, CDKN2, MTS1, Cyclin-Dependent Kinase Inhibitor 2A (Melanoma, P16, Inhibits CDK4), Cyclin-Dependent Kinase 4 Inhibitor A, Multiple Tumor Suppressor 1, CDK4I, MTS-1, CMM2, P16, ARF, INK4, INK4A, P14, P14ARF, P16-INK4A, P16INK4, P16INK4A, P19, P19ARF, TP16, CDK4 Inhibitor P16-INK4, Cell Cycle Negative Regulator Beta, p14ARF, p16-INK4, p16-INK4a, p16INK4A, p19ARF; NP); CEA; CLL1 (CLL-1 (CLEC12A, MICL, and DCAL, encodes a member of the C-type lectin/C-type lectin-like domain (CTL/CTLD) superfamily. Members of this family share a common protein fold and have diverse functions, such as cell adhesion, cell-cell signaling, glycoprotein turnover, and roles in inflammation and immune response. The protein encoded by this gene is a negative regulator of granulocyte and monocyte function. Several alternatively spliced transcript variants of this gene have been described, but the full-length nature of some of these variants has not been determined. This gene is closely linked to other CTL/CTLD superfamily members in the natural killer gene complex region on chromosome 12p13 (Drickamer, K Curr. Opin. Struct. Biol. 9:585-90 [1999]; van Rhenen, A, et al., Blood 110:2659-66 [2007]; Chen C H, et al. Blood 107:1459-67 [2006]; Marshall A S, et al. Eur. J. Immunol. 36:2159-69 [2006]; Bakker A B, et al Cancer Res. 64:8443-50 [2004]; Marshall A S, et al J. Biol. Chem. 279:14792-80, 2004. CLL-1 has been shown to be a type II transmembrane receptor comprising a single C-type lectin-like domain (which is not predicted to bind either calcium or sugar), a stalk region, a transmembrane domain and a short cytoplasmic tail containing an ITIM motif.); CLPP (Caseinolytic Mitochondrial Matrix Peptidase Proteolytic Subunit, Endopeptidase Clp, EC 3.4.21.92, PRLTS3, ATP-Dependent Protease ClpAP (*E. coli*), ClpP (Caseinolytic Protease, ATP-Dependent, Proteolytic Subunit, *E. coli*) Homolog, ClpP Caseinolytic Peptidase, ATP-Dependent, Proteolytic Subunit Homolog (*E. coli*), ClpP Caseinolytic Protease, ATP-Dependent, Proteolytic Subunit Homolog (*E. coli*), human, Proteolytic Subunit, ATP-Dependent Protease ClpAP, Proteolytic Subunit, Human, ClpP Caseinolytic Peptidase ATP-Dependent, Proteolytic Subunit, ClpP Caseinolytic Peptidase, ATP-Dependent, Proteolytic Subunit Homolog, ClpP Caseinolytic Protease, ATP-Dependent, Proteolytic Subunit Homolog, Putative ATP-Dependent Clp Protease Proteolytic Subunit, Mitochondrial; NP); COA-1; CPSF; CRIPTO (CRIPTO (CR, CR1, CRGF, CRIPTO, TDGF 1, teratocarcinoma-derived growth factor, Genbank accession no. NP-003203 or NM-00321); Cw6; CXCR5 CXCR5 (Burkitt's lymphoma receptor 1, a G protein-coupled receptor that is activated by the CXCL13 chemokine, functions in lymphocyte migration and humoral defense, plays a role in HIV-2 infection and perhaps development of AIDS, lymphoma, myeloma, and leukemia); 372 aa, μl: 8.54 MW: 41959 TM: 7 [P] Gene Chromosome: 11q23.3, Genbank accession No. NP-001707.); CXORF61 CXORF61-chromosome X open reading frame 61[*Homo sapiens*], NCBI Reference Sequence: NP-001017978.1);

cyclin D1 (CCND1, BCL1, PRAD1, D11S287E, B-Cell CLL/Lymphoma 1, B-Cell Lymphoma 1 Protein, BCL-1 Oncogene, PRAD1 Oncogene, Cyclin D1 (PRAD1: Parathyroid Adenomatosis 1), G1/S-Specific Cyclin D1, Parathyroid Adenomatosis 1, U21B31, G1/S-Specific Cyclin-D1, BCL-1; NCBI Reference Sequence: NP-444284.1); Cyclin-A1 (CCNA1, CT146, Cyclin A1; GenBank: AAH36346.1); dek-can fusion protein; DKK1 (Dickkopf WNT Signaling Pathway Inhibitor 1, SK, hDkk-1, Dickkopf (*Xenopus laevis*) Homolog 1, Dickkopf 1 Homolog (*Xenopus laevis*), DKK-1, Dickkopf 1 Homolog, Dickkopf Related Protein-1, Dickkopf-1 Like, Dickkopf-Like Protein 1, Dickkopf-Related Protein 1, Dickkopf-1, Dkk-1; GenBank: AAQ89364.1); DR1 (Down-Regulator Of Transcription 1, TBP-Binding (Negative Cofactor 2), Negative Cofactor 2-Beta, TATA-Binding Protein-Associated Phosphoprotein, NC2, NC2-BETA, Protein Dr1, NC2-beta, Down-Regulator Of Transcription 1; NCBI Reference Sequence: NP-001929.1); DR13 (Major Histocompatibility Complex, Class II, DR Beta 1, HLA-DR1B, DRw10, DW2.2/DR2.2, SS1, DRB1, HLA-DRB, HLA Class II Histocompatibility Antigen, DR-1 Beta Chain, Human Leucocyte Antigen DRB1, Lymphocyte Antigen DRB1, MHC Class II Antigen, MHC Class II HLA-DR Beta 1 Chain, MHC Class II HLA-DR-Beta Cell Surface Glycoprotein, MHC Class II HLA-DRw10-Beta, DR-1, DR-12, DR-13, DR-14, DR-16, DR-4, DR-5, DR-7, DR-8, DR-9, DR1, DR12, DR13, DR14, DR16, DR4, DR5, DR7, DRB, DR9, DRw11, DRw8, HLA-DRB2, Clone P2-Beta-3, MHC Class II Antigen DRB1*1, MHC Class II Antigen DRB1*10, MHC Class II Antigen DRB1*11, MHC Class II Antigen DRB1*12, MHC Class II Antigen DRB1*13, MHC Class II Antigen DRB1*14, MHC Class II Antigen DRB1*15, MHC Class II Antigen DRB1*16, MHC Class II Antigen DRB1*3, MHC Class II Antigen DRB1*4, MHC Class II Antigen DRB1*7, MHC Class II Antigen DRB1*8, MHC Class II Antigen DRB1*9; NP); E16 (E16 (LAT1, SLC7A5, Genbank accession no. NM-00348); EDAR (EDAR—tumor necrosis factor receptor superfamily member EDAR precursor, EDA-A1 receptor; downless homolog; ectodysplasin-A receptor; ectodermal dysplasia receptor; anhidrotic ectodysplasin receptor 1, DL; ECTD10A; ECTD10B; ED1R; ED3; ED5; EDA-AIR; EDA1R; EDA3; HRM1 [*Homo sapiens*]; NCBI Reference Sequence: NP-071731.1); EFTUD2 (Elongation Factor Tu GTP Binding Domain Containing 2, Elongation Factor Tu GTP-Binding Domain-Containing Protein 2, hSNU114, SNU114 Homolog, U5 SnRNP-Specific Protein, 116 KDa, MFDGA, KIAA0031, 116 KD, U5 SnRNP Specific Protein, 116 KDa U5 Small Nuclear Ribonucleoprotein Component, MFDM, SNRNP116, Snrp116, Snu114, U5-116KD, SNRP116, U5-116 KDa; GenBank: AAH02360.1); EGFR (Epidermal Growth Factor Receptor, ERBB, Proto-Oncogene C-ErbB-1, Receptor Tyrosine-Protein Kinase ErbB-1, ERBB1, HER1, EC 2.7.10.1, Epidermal Growth Factor Receptor (Avian Erythroblastic Leukemia Viral (V-Erb-B) Oncogene Homolog), Erythroblastic Leukemia Viral (V-Erb-B) Oncogene Homolog (Avian), P1G61, Avian Erythroblastic Leukemia Viral (V-Erb-B) Oncogene Homolog, Cell Growth Inhibiting Protein 40, Cell Proliferation-Inducing Protein 61, mENA, EC 2.7.10; GenBank: AAH94761.1); EGFR-G719A; EGFR-G719C; EGFR-G719S; EGFR-L858R; EGFR-L861 Q; EGFR-57681; EGFR-T790M; Elongation factor 2 (EEF2, Eukaryotic Translation Elongation Factor 2, EF2, Polypeptidyl-TRNA Translocase, EF-2, SCA26, EEF-2; NCBI Reference Sequence: NP-001952.1); ENAH (hMena) (Enabled Homolog (*Drosophila*), MENA, Mammalian Enabled, ENA, NDPP1, Protein Enabled Homolog; GenBank: AAH95481.1)-results for just "ENAH" not "ENAH (hMena)"; EpCAM (Epithelial Cell Adhesion Molecule, M4S1, MIC 18, Tumor-Associated Calcium Signal Transducer 1, TACSTD1, TROP1, Adenocarcinoma-Associated Antigen, Cell Surface Glycoprotein Trop-1, Epithelial Glycoprotein 314, Major Gastrointestinal Tumor-Associated Protein GA733-2, EGP314, KSA, DIAR5, HNPCC8, Antigen Identified By Monoclonal Antibody AUA1, EGP-2, EGP40, ESA, KS 1/4, MK-1, Human Epithelial Glycoprotein-2, Membrane Component, Chromosome 4, Surface Marker (35 kD Glycoprotein), EGP, Ep-CAM, GA733-2, M1S2, CD326 Antigen, Epithelial Cell Surface Antigen, hEGP314, KS 1/4 Antigen, ACSTD1; GenBank: AAH14785.1); EphA3 (EPH Receptor A3, ETK1, ETK, TYRO4, HEK, Eph-Like Tyrosine Kinase 1, Tyrosine-Protein Kinase Receptor ETK1, EK4, EPH-Like Kinase 4, EC 2.7.10.1, EPHA3, HEK4, Ephrin Type-A Receptor 3, Human Embryo Kinase 1, TYRO4 Protein Tyrosine Kinase, hEK4, Human Embryo Kinase, Tyrosine-Protein Kinase TYRO4, EC 2.7.10; GenBank: AAH63282.1); EphB2R; Epiregulin (EREG, ER, proepiregulin; GenBank: AAI36405.1); ETBR (EDNRB, Endothelin Receptor Type B, HSCR2, HSCR, Endothelin Receptor Non-Selective Type, ET-B, ET-BR, ETRB, ABCDS, WS4A, ETB, Endothelin B Receptor; NP); ETV6-AML1 fusion protein; EZH2 (Enhancer Of Zeste Homolog 2 (*Drosophila*), Lysine N-Methyltransferase 6, ENX-1, KMT6 EC 2.1.1.43, EZH1, WVS, Enhancer Of Zeste (*Drosophila*) Homolog 2, ENX1, EZH2b, KMT6A, WVS2, Histone-Lysine N-Methyltransferase EZH2, Enhancer Of Zeste Homolog 2, EC 2.1.1; GenBank: AAH10858.1); FcRH1 (FCRL1, Fc Receptor-Like 1, FCRH1, Fc Receptor Homolog 1, FcR-Like Protein 1, Immune Receptor Translocation-Associated Protein 5, IFGP1, IRTA5, hIFGP1, IFGP Family Protein 1, CD307a, Fc Receptor-Like Protein 1, Immunoglobulin Superfamily Fc Receptor, Gp42, FcRL1, CD307a Antigen; GenBank: AAH33690.1); FcRH2 (FCRL2, Fc Receptor-Like 2, SPAP1, SH2 Domain-Containing Phosphatase Anchor Protein 1, Fc Receptor Homolog 2, FcR-Like Protein 2, Immunoglobulin Receptor Translocation-Associated Protein 4, FCRH2, IFGP4, IRTA4, IFGP Family Protein 4, SPAP1A, SPAP1 B, SPAP1C, CD307b, Fc Receptor-Like Protein 2, Immune Receptor Translocation-Associated Protein 4, Immunoglobulin Superfamily Fc Receptor, Gp42, SH2 Domain Containing Phosphatase Anchor Protein 1, FcRL2, CD307b Antigen; GenBank: AAQ88497.1); FcRH5 (FCRL5, Fc Receptor-Like 5, IRTA2, Fc Receptor Homolog 5, FcR-Like Protein 5, Immune Receptor Translocation-Associated Protein 2, BXMAS1, FCRH5, CD307, CD307e, PRO820, Fc Receptor-Like Protein 5, Immunoglobulin Superfamily Receptor Translocation Associated 2 (IRTA2), FCRL5, CD307e Antigen; GenBank: AAI01070.1); FLT3-ITD; FN1(Fibronectin 1, Cold-Insoluble Globulin, FN, Migration-Stimulating Factor, CIG, FNZ, GFND2, LETS, ED-B, FINC, GFND, MSF, fibronectin; GenBank: AAI43764.1); G250 (MN, CAIX, Carbonic Anhydrase IX, Carbonic Dehydratase, RCC-Associated Protein G250, Carbonate Dehydratase IX, Membrane Antigen MN, Renal Cell Carcinoma-Associated Antigen G250, CA-IX, P54/58N, pMW1, RCC-Associated Antigen G250, Carbonic Anhydrase 9; NP); —alias results for "G250" not "G250/MN/CAIX"; GAGE-1,2,8; GAGE-3,4,5,6,7; GDNF-Ra1 (GDNF family receptor alpha 1; GFRA1; GDNFR; GDNFRA; RETL1; TRNR1; RET1 L; GDNFR-alpha1; GFR-ALPHA-; U95847; BC014962; NM-145793 NM-005264); GEDA (Genbank accession No. AY26076); GFRA1-GDNF family receptor alpha-1; GDNF receptor alpha-1; GDNFR-alpha-1; GFR-alpha-1; RET ligand 1; TGF-beta-related neurotrophic factor receptor 1 [Homo sapiens]; ProtKB/Swiss-Prot: P56159.2; glypican-3 (GPC3, Glypican 3, SDYS, Glypican Proteoglycan 3, Intestinal Protein OCI-5, GTR2-2, MXR7, SGBS1, DGSX, OCI-5. SGB, SGBS, Heparan Sulphate Proteoglycan, Secreted Glypican-3, OCI5; GenBank: AAH35972.1); GnTVf; gp100 (PMEL, Premelanosome Protein, SILV, D12S53E, PMEL17, SIL, Melanocyte Protein Pmel 17, Melanocytes Lineage-Specific Antigen GP100, Melanoma-Associated ME20 Antigen, Silver Locus Protein Homolog, ME20-M, ME20M, P1, P100, Silver (Mouse Homolog) Like, Silver Homolog (Mouse), ME20, SI, Melanocyte Protein Mel 17, Melanocyte Protein PMEL, Melanosomal Matrix Protein17, Silver, Mouse, Homolog Of; GenBank: AAC60634.1); GPC; GPNMB (Glycoprotein (Transmembrane) Nmb, Glycoprotein NMB, Glycoprotein Nmb-Like Protein, osteoactivin, Transmembrane Glycoprotein HGFIN, HGFIN, NMB, Transmembrane Glycoprotein, Transmembrane Glycoprotein NMB; GenBank: AAH32783.1); GPR172A (G protein-coupled receptor 172A; GPCR41; FLJ11856; D15Ertd747e); NP-078807.1; NM-024531.3); GPR19 (G protein-coupled receptor 19; Mm.478; NP-006134.1; NM-006143.2); GPR54 (KISS1 receptor; KISS1R; GPR54; HOT7T175; AXOR1; NP-115940.2; NM-032551.4); HAVCR1 (Hepatitis A Virus Cellular Receptor 1, T-Cell Immunoglobulin Mucin Family Member 1, Kidney Injury Molecule 1, KIM-1, KIM1, TIM, TIM-1, TIM1, TIMD-1, TIMD1, T-Cell Immunoglobulin Mucin Receptor 1, T-Cell Membrane Protein 1, HAVCR, HAVCR-1, T Cell Immunoglobin Domain And Mucin Domain Protein 1, HAVcr-1, T-Cell Immunoglobulin And Mucin Domain-Containing Protein 1; GenBank: AAH13325.1); HER2 (ERBB2, V-Erb-B2 Avian Erythroblastic Leukemia Viral Oncogene Homolog 2, NGL, NEU, Neuro/Glioblastoma Derived Oncogene Homolog, Metastatic Lymph Node Gene 19 Protein, Proto-Oncogene C-ErbB-2, Proto-Oncogene Neu, Tyrosine Kinase-Type Cell Surface Receptor HER2, MLN 19, p185erbB2, EC 2.7.10.1, V-Erb-B2 Avian Erythroblastic Leukemia Viral Oncogene Homolog 2 (Neuro/Glioblastoma Derived Oncogene Homolog), CD340, HER-2, HER-2/neu, TKR1, C-Erb B2/Neu Protein, herstatin, Neuroblastoma/Glioblastoma Derived Oncogene Homolog, Receptor Tyrosine-Protein Kinase ErbB-2, V-Erb-B2 Erythroblastic Leukemia Viral Oncogene Homolog 2, Neuro/Glioblastoma Derived Oncogene Homolog, MLN19, CD340 Antigen, EC 2.7.10; NP); HER-2/neu-alias of above; HERV-K-MEL; HLA-DOB (Beta subunit of MHC class II molecule (1a antigen) that binds peptides and presents them to CD4+ T lymphocytes); 273 aa, μl: 6.56, MW: 30820.TM: 1 [P] Gene Chromosome: 6p21.3, Genbank accession No. NP-002111); hsp70-2 (HSPA2, Heat Shock 70 kDa Protein 2, Heat Shock 70 kD Protein 2, HSP70-3, Heat Shock-Related 70 KDa Protein 2, Heat Shock 70 KDa Protein 2; GenBank: AAD21815.1); IDO1 (Indoleamine 2,3-Dioxygenase 1, IDO, INDO, Indoleamine-Pyrrole 2,3-Dioxygenase, IDO-1, Indoleamine-Pyrrole 2,3 Dioxygenase, Indolamine 2,3 Dioxygenase, Indole 2,3 Dioxygenase, EC 1.13.11.52; NCBI Reference Sequence: NP-002155.1); IGF2B3; IL13Ralpha2 (IL13RA2, Interleukin 13 Receptor, Alpha 2, Cancer/Testis Antigen 19, Interleukin-13-Binding Protein, IL-13R-alpha-2, IL-13RA2, IL-13 Receptor Subunit Alpha-2, IL-13R Subunit Alpha-2, CD213A2, IL-13R, IL13BP, Interleukin 13 Binding Protein, Interleukin 13 Receptor Alpha 2 Chain, Interleukin-13 Receptor Subunit Alpha-2, IL13R, CD213a2 Antigen; NP); IL20Rα; Intestinal carboxyl esterase; IRTA2 (alias of FcRH5); Kallikrein 4 (KLK4, Kallikrein-Related Peptidase 4, PRSS17, EMSP1, Enamel Matrix Serine Proteinase 1, Kallikrein-Like Protein 1, Serine Protease 17, KLK-L1, PSTS, AI2A1, Kallikrein 4 (Prostase, Enamel Matrix, Prostate), ARM1, EMSP, Androgen-Regulated Message 1, Enamel Matrix Serine Protease 1, kallikrein, kallikrein-4, prostase, EC 3.4.21.-, Prostase, EC 3.4.21; GenBank: AAX30051.1); KIF20A (Kinesin Family Member 20A, RAB6KIFL, RAB6 Interacting, Kinesin-Like (Rabkinesin6), Mitotic a; LAGE-1; LDLR-fucosyltransferase AS fusion protein; Lengsin (LGSN, Lengsin, Lens Protein With Glutamine Synthetase Domain, GLULD1, Glutamate-Ammonia Ligase Domain-Containing Protein 1, LGS, Glutamate-Ammonia Ligase (Glutamine Synthetase) Domain Containing 1, Glutamate-Ammonia Ligase (Glutamine Synthase) Domain Containing 1, Lens Glutamine Synthase-Like; GenBank: AAF61255.1); LGR5 (leucine-rich repeat-containing G protein-coupled receptor 5; GPR49, GPR6; NP-003658.1; NM-003667.2; LY64 (Lymphocyte antigen 64 (RP10, type I membrane protein of the leucine rich repeat (LRR) family, regulates B-cell activation and apoptosis, loss of function is associated with increased disease activity in patients with systemic lupus erythematosis); 661 aa, μl: 6.20, MW: 74147 TM: 1 [P] Gene Chromosome: 5q12, Genbank accession No. NP-005573.; Ly6E (lymphocyte antigen 6 complex, locus E; Ly67, RIG-E, SCA-2, TSA-; NP-002337.1; NM-002346.2); Ly6G6D (lymphocyte antigen 6 complex, locus G6D; Ly6-D, MEGT; NP-067079.2; NM-021246.2); LY6K (lymphocyte antigen 6 complex, locus K; LY6K; HSJ001348; FLJ3522; NP-059997.3; NM-017527.3); LyPD1-LY6/PLAUR domain containing 1, PHTS [Homo sapiens], GenBank: AAH17318.1); MAGE-A1 (Melanoma Antigen Family A, 1 (Directs Expression Of Antigen MZ2-E, MAGE1, Melanoma Antigen Family A 1, MAGEA1, Melanoma Antigen MAGE-1, Melanoma-Associated Antigen 1, Melanoma-Associated Antigen MZ2-E, Antigen MZ2-E, Cancer/Testis Antigen 1.1, CT1.1, MAGE-1 Antigen, Cancer/Testis Antigen Family 1, Member 1, Cancer/Testis Antigen Family 1, Member 1, MAGE1A; NCBI Reference Sequence: NP-004979.3); MAGE-A10 (MAGEA10, Melanoma Antigen Family A, 10, MAGE10, MAGE-10 Antigen, Melanoma-Associated Antigen 10, Cancer/Testis Antigen 1.10, CT1.10, Cancer/Testis Antigen Family 1, Member 10, Cancer/Testis Antigen Family 1, Member 10; NCBI Reference Sequence: NP-001238757.1); MAGE-A12 (MAGEA12, Melanoma Antigen Family A, 12, MAGE12, Cancer/Testis Antigen 1.12, CT1.12, MAGE12F Antigen, Cancer/Testis Antigen Family 1, Member 12, Cancer/Testis Antigen Family 1, Member 12, Melanoma-Associated Antigen 12, MAGE-12 Antigen; NCBI Reference Sequence: NP-001159859.1); MAGE-A2 (MAGEA2, Melanoma Antigen Family A, 2, MAGE2, Cancer/Testis Antigen 1.2, CT1.2, MAGEA2A, MAGE-2 Antigen, Cancer/Testis Antigen Family 1, Member 2, Cancer/Testis Antigen Family 1, Member 2, Melanoma Antigen 2, Melanoma-Associated Antigen 2; NCBI Reference Sequence: NP-001269434.1); MAGE-A3 (MAGEA3, Melanoma Antigen Family A, 3, MAGE3, MAGE-3 Antigen, Antigen MZ2-D, Melanoma-Associated Antigen 3, Cancer/Testis Antigen 1.3, CT1.3, Cancer/Testis Antigen Family 1, Member 3, HIPS, HYPD, MAGEA6, Cancer/Testis Antigen Family 1, Member 3; NCBI Reference Sequence: NP-005353.1); MAGE-A4 (MAGEA4, Melanoma Antigen Family A, 4, MAGE4, Melanoma-Associated Antigen 4, Cancer/Testis Antigen 1.4, CT1.4, MAGE-4 Antigen, MAGE-41 Antigen, MAGE-X2 Antigen, MAGE4A, MAGE4B, Cancer/Testis Antigen Family 1, Member 4, MAGE-41, MAGE-X2, Cancer/Testis Antigen Family 1, Member 4; NCBI Reference Sequence: NP-001011550.1); MAGE-A6 (MAGEA6, Melanoma Antigen Family A, 6, MAGE6, MAGE-6 Antigen, Melanoma-Associated Antigen 6, Cancer/Testis Antigen 1.6, CT1.6, MAGE3B Antigen, Cancer/Testis Antigen Family 1, Melanoma Antigen Family A 6, Member 6, MAGE-3b, MAGE3B, Cancer/Testis Antigen Family 1, Member 6; NCBI Reference Sequence: NP-787064.1); MAGE-A9 (MAGEA9, Melanoma Antigen Family A, 9, MAGE9, MAGE-9 Antigen, Melanoma-Associated Antigen 9, Cancer/Testis Antigen 1.9, CT1.9, Cancer/Testis Antigen Family 1, Member 9, Cancer/Testis Antigen Family 1, Member 9, MAGEA9A; NCBI Reference Sequence: NP-005356.1); MAGE-C1 (MAGEC1, Melanoma Antigen Family C, 1, Cancer/Testis Antigen 7.1, CT7.1, MAGE-C1 Antigen, Cancer/Testis Antigen Family 7, Member 1, CT7, Cancer/Testis Antigen Family 7, Member 1, Melanoma-Associated Antigen C1; NCBI Reference Sequence: NP-005453.2); MAGE-C2 (MAGEC2, Melanoma Antigen Family C, 2, MAGEE1, Cancer/Testis Antigen 10, CT10, HCA587, Melanoma Antigen, Family E, 1, Cancer/Testis Specific, Hepatocellular Carcinoma-Associated Antigen 587, MAGE-C2 Antigen, MAGE-E1 Antigen, Hepatocellular Cancer Antigen 587, Melanoma-Associated Antigen C2; NCBI Reference Sequence: NP-057333.1); mammaglobin-A (SCGB2A2, Secretoglobin, Family 2A, Member 2, MGB1, Mammaglobin 1, UGB2, Mammaglobin A, mammaglobin-A, Mammaglobin-1, Secretoglobin Family 2A Member 2; NP); MART2 (H HAT, Hedgehog Acyltransferase, SKI1, Melanoma Antigen Recognized By T-Cells 2, Skinny Hedgehog Protein 1, Skn, Melanoma Antigen Recognized By T Cells 2, Protein-Cysteine N-Palmitoyltransferase HHAT, EC 2.3.1.-; GenBank: AAH39071.1); M-CSF (CSF1, Colony Stimulating Factor 1 (Macrophage), MCSF, CSF-1, lanimostim, Macrophage Colony-Stimulating Factor 1, Lanimostim; GenBank: AAH21117.1); MCSP (SMCP, Sperm Mitochondria-Associated Cysteine-Rich Protein, MCS, Mitochondrial Capsule Selenoprotein, HSMCSGEN1, Sperm Mitochondrial-Associated Cysteine-Rich Protein; NCBI Reference Sequence: NP-109588.2); XAGE-1b/GAGED2a; WT1 (Wilms Tumor 1, WAGR, GUD, WIT-2, WT33, Amino-Terminal Domain Of EWS, NPHS4, Last Three Zinc Fingers Of The DNA-Binding Domain Of WT1, AWT 1, Wilms Tumor Protein, EWS-WT1; GenBank: AAB33443.1); VEGF; Tyrosinase (TYR; OCAIA; OCA1A; tyrosinase; SHEP; NP-000363.1; NM-000372.4; GenBank: AAB60319.1); TrpM4 (BR22450, FLJ20041, TRPM4, TRPM4B, transient receptor potential cation channel, subfamily M, member 4, Genbank accession no. NM-01763); TRP2-INT2; TRP-2; TRP-1/gp75 (Tyrosinase-Related Protein 1, 5,6-Dihydroxyindole-2-Carboxylic Acid Oxidase, CAS2, CATB, TYRP, OCAS, Catalase B, b-PROTEIN, Glycoprotein 75, EC 1.14.18, Melanoma Antigen Gp75, TYRP1, TRP, TYRRP, TRP1, SHEP11, DHICA Oxidase, EC 1.14.18, GP75, EC 1.14.18.1; Triosephosphate isomerase (Triosephosphate isomerase 1, TPID, Triose-Phosphate Isomerase, HEL-S-49, TIM, Epididymis Secretory Protein Li 49, TPI, Triosephosphate Isomerase, EC 5.3.1.1; TRAG-3 (CSAG Family Member 2, Cancer/Testis Antigen Family 24, CSAG3B, Member 2, CSAG Family Member 3B, Cancer/Testis Antigen Family 24 Member 2, Cancer/Testis Antigen 24.2, Chondrosarcoma-Associated Gene 2/3 Protein, Taxol-Resistant-Associated Gene 3 Protein, Chondrosarcoma-Associated Gene 2/3 Protein-Like, CT24.2, Taxol Resistance Associated Gene 3, TRAG-3, CSAG3A, TRAG3;); TMEM46 (shisa homolog 2 (*Xenopus laevis*); SHISA; NP-001007539.1; NM-001007538.1; TMEM118 (ring finger protein, transmembrane2; RNFT2; FLJ1462; NP-001103373.1; NM-001109903.1; TMEFF1 (transmembrane protein with EGF-like and two follistatin-like domains 1; Tomoregulin-; H7365; C9orf2; C90RF2; U19878; X83961; NM-080655; NM-003692; TGF-betaRII (TGFBR2, Transforming Growth Factor, Beta Receptor II (70/80 kDa), TGFbeta-RII, MFS2, tbetaR-II, TGFR-2, TGF-Beta Receptor Type IIB, TGF-Beta Type II Receptor, TGF-Beta Receptor Type-2, EC 2.7.11.30, Transforming Growth Factor Beta Receptor Type IIC, AAT3, TbetaR-II, Transforming Growth Factor, Beta Receptor II (70-80 kD), TGF-Beta Receptor Type II, FAA3, Transforming Growth Factor-Beta Receptor Type II, LDS1 B, HNPCC6, LDS2B, LDS2, RITC, EC 2.7.11, TAAD2); TENB2 (TMEFF2, tomoregulin, TPEF, HPP1, TR, putative transmembrane proteoglycan, related to the EGF/heregulin family of growth factors and follistatin); 374 aa, NCBI Accession: AAD55776, AAF91397, AAG49451, NCBI RefSeq: NP-057276; NCBI Gene: 23671; OMIM: 605734; SwissProt Q9UIK5; Genbank accession No. AF179274; AY358907, CAF85723, CQ782436; TAG-2; TAG-1 (Contactin 2 (Axonal), TAG-1, AXT, Axonin-1 Cell Adhesion Molecule, TAX, Contactin 2 (transiently Expressed), TAXI, Contactin-2, Axonal Glycoprotein TAG-1, Transiently-Expressed Axonal Glycoprotein, Transient Axonal Glycoprotein, Axonin-1, TAX-1, TAG1, FAMES; PRF: 444868); SYT-SSX1 or -SSX2 fusion protein; survivin; STEAP2 (HGNC 8639, IPCA-1, PCANAP1, STAMP1, STEAP2, STMP, prostate cancer associated gene 1, prostate cancer associated protein 1, six transmembrane epithelial antigen of prostate 2, six transmembrane prostate protein, Genbank accession no. AF45513; STEAP1 (six transmembrane epithelial antigen of prostate, Genbank accession no. NM-01244); SSX-4; SSX-2 (SSX2, Synovial Sarcoma, X Breakpoint2, X Breakpoint 2, SSX, X Breakpoint 2B, Cancer/Testis Antigen 5.2, X-Chromosome-Related 2, Tumor Antigen HOM-MEL-40, CT5.2, HD21, Cancer/Testis Antigen Family 5, HOM-MEL-40, Isoform B, Cancer/Testis Antigen Family 5 member 2a, member 2a, Protein SSX2, Sarcoma, Sarcoma, Synovial, X-Chromosome-Related 2, synovial, Synovial Sarcoma, X Breakpoint 2B, Synovial Sarcomam, SSX2A; Sp17; SOX10 (SRY (Sex Determining Region Y)-Box 10, mouse, PCWH, DOM, WS4, WS2E, WS4C, Dominant Megacolon, mouse, Human Homolog Of, Dominant Megacolon, SRY-Related HMG-Box Gene 10, Human Homolog Of, transcription Factor SOX-10; GenBank: CAG30470.1); SNRPD1 (Small Nuclear Ribonucleoprotein D1, Small Nuclear Ribonucleoprotein D1, Polypeptide 16 kDa, Polypeptide (16 kD), SNRPD, HsT2456, Sm-D1, SMD 1, Sm-D Autoantigen, Small Nuclear Ribonucleoprotein D1 Polypeptide 16 kDa Pseudogene, SnRNP Core Protein D1, Small Nuclear Ribonucleoprotein Sm D1; SLC35D3 (Solute Carrier Family 35, Member D3, FRCL1, Fringe Connection-Like Protein 1, bA55K22.3, Frc, Fringe-Like 1, Solute Carrier Family 35 Member D3; NCBI GenBank: NC-000006.11 NC-018917.2 NT-025741.16); SIRT2 (Sirtuin 2, NAD-Dependent Deacetylase Sirtuin-2, SIRL2, Silent Information Regulator 2, Regulatory Protein SIR2 Homolog 2, Sir2-Related Protein Type 2, SIR2-Like Protein 2, Sirtuin Type 2, Sirtuin (Silent Mating Type Information Regulation 2 Homolog) 2 (*S. cerevisiae*), Sirtuin-2, Sirtuin (Silent Mating Type Information Regulation 2, *S. cerevisiae*, Homolog) 2, EC 3.5.1, SIR2; GenBank: AAK51133.1); Sema 5b (FLJ10372, KIAA1445, Mm.42015, SEMA5B, SEMAG, Semaphorin 5b Hlog, sema domain, seven thrombospondin repeats (type 1 and type 1-like), Transmembrane Domain™ and short cytoplasmic domain, (semaphorin) 5B, Genbank accession no. AB04087; secernin 1 (SCRN1, SES1, KIAA0193, secerin-1; GenBank: EAL24458.1); SAGE (SAGE1, Sarcoma Antigen 1, Cancer/Testis Antigen 14, CT14, Putative Tumor Antigen; NCBI Reference Sequence: NP-061136.2); RU2AS (KAAG1, Kidney Associated Antigen 1, RU2AS, RU2 Antisense Gene Protein, Kidney-Associated Antigen 1; GenBank: AAF23613.1); RNF43-E3 ubiquitin-protein ligase RNF43 precursor [Homo sapiens], RNF124; URCC; NCBI Reference Sequence: NP-060233.3; RhoC (RGS5 (Regulator Of G-Protein Signaling 5, MSTP032, Regulator Of G-Protein Signalling 5, MSTP092, MST092, MSTP106, MST106, MSTP129, MST129; GenBank: AAB84001.1); RET (ret proto-oncogene; MEN2A; HSCR1; MEN2B; MTC1; PTC; CDHF12; Hs.168114; RET51; RET-ELE; NP-066124.1; NM-020975.4); RBAF600 (UBR4, Ubiquitin Protein Ligase E3 Component N-Recognin 4, Zinc Finger, UBR1 Type 1, ZUBR1, E3 Ubiquitin-Protein Ligase UBR4, RBAF600, 600 KDa Retinoblastoma Protein-Associated Factor, Zinc Finger UBR1-Type Protein 1, EC 6.3.2, N-recognin-4, KIAA0462, p600, EC 6.3.2, KIAA1307; GenBank: AAL83880.1); RAGE-1 (MOK, MOK Protein Kinase, Renal Tumor Antigen, RAGE, MAPK/MAK/MRK Overlapping Kinase, Renal Tumor Antigen 1, Renal Cell Carcinoma Antigen, RAGE-1, EC 2.7.11.22, RAGE1; UniProtKB/Swiss-Prot: Q9UQ07.1); RAB38/NY-MEL-1 (RAB38, NY-MEL-1, RAB38, Member RAS Oncogene Family, Melanoma Antigen NY-MEL-1, Rab-Related GTP-Binding Protein, Ras-Related Protein Rab-38, rrGTPbp; GenBank: AAH15808.1); PTPRK (DJ480J14.2.1 (Protein Tyrosine Phosphatase, Receptor Type, K R-PTP-KAPPA, Protein Tyrosine Phosphatase Kappa, Protein Tyrosine Phosphatase Kappa), Protein Tyrosine Phosphatase, Receptor Type, K, Protein-Tyrosine Phosphatase Kappa, Protein-Tyrosine Phosphatase, Receptor Type, Kappa, R-PTP-kappa, Receptor-Type Tyrosine-Protein Phosphatase Kappa, EC 3.1.3.48, PTPK; GenBank: AAI44514.1); PSMA; PSCA hIg (2700050C12Rik, C530008016Rik, RIKEN cDNA 2700050C12, RIKEN cDNA 2700050C12 gene, Genbank accession no. AY358628); PSCA (Prostate stem cell antigen precursor, Genbank accession no. AJ29743; PRDX5 (Peroxiredoxin 5, EC 1.11.1.15, TPx Type VI, B166, Antioxidant Enzyme B166, HEL-S-55, Liver Tissue 2D-Page Spot 71 B, PMP20, Peroxisomal Antioxidant Enzyme, PRDX6, Thioredoxin Peroxidase PMP20, PRXV, AOEB 166, Epididymis Secretory Protein Li 55, Alu Co-Repressor 1, Peroxiredoxin-5, Mitochondrial, Peroxiredoxin V, prx-V, Thioredoxin Reductase, Prx-V, ACR1, Alu Corepressor, PLP; GenBank: CAG33484.1); PRAME (Preferentially Expressed Antigen In Melanoma, Preferentially Expressed Antigen Of Melanoma, MAPE, 01P-4, OIPA, CT130, Cancer/Testis Antigen 130, Melanoma Antigen Preferentially Expressed In Tumors, Opa-Interacting Protein 4, Opa-Interacting Protein 01P4; GenBank: CAG30435.1); pml-RARalpha fusion protein; PMEL17 (silver homolog; SILV; D12S53E; PMEL17; SI; SIL); ME20; gp10 BC001414; BT007202; M32295; M77348; NM-006928; PBF (ZNF395, Zinc Finger Protein 395, PRF-1, Huntington disease regulatory, HD Gene Regulatory Region-Binding Protein, Region-Binding Protein 2, Protein 2, Papillomavirus Regulatory Factor 1, HD-Regulating Factor 2, Papillomavirus-Regulatory Factor, PRF1, HDBP-2, Si-1-8-14, HDBP2, Huntington'S Disease Gene Regulatory Region-Binding Protein 2, HDRF-2, Papillomavirus Regulatory Factor PRF-1, PBF; GenBank: AAH01237.1); PAX5 (Paired Box 5, Paired Box Homeotic Gene 5, BSAP, Paired Box Protein Pax-5, B-Cell Lineage Specific Activator, Paired Domain Gene 5, Paired Box Gene 5 (B-Cell Lineage Specific Activator Protein), B-Cell-Specific Transcription Factor, Paired Box Gene 5 (B-Cell Lineage Specific Activator); PAP (REG3A, Regenerating Islet-Derived 3 Alpha, INGAP, PAP-H, Hepatointestinal Pancreatic Protein, PBBCGF, Human Proislet Peptide, REG-Ill, Pancreatitis-Associated Protein 1, Regi, Reg III-Alpha, hepatocarcinoma-intestine-pancreas, Regenerating Islet-Derived Protein III-Alpha, Pancreatic Beta Cell Growth Factor, HIP, PAP Homologous Protein, HIP/PAP, Proliferation-Inducing Protein 34, PAP1, Proliferation-Inducing Protein 42, REG-3-alpha, Regenerating Islet-Derived Protein 3-Alpha, Pancreatitis-Associated Protein; GenBank: AAH36776.1); p53 (TP53, Tumor Protein P53, TPR53, P53, Cellular Tumor Antigen P53, Antigen NY-CO-13, Mutant Tumor Protein 53, Phosphoprotein P53, P53 Tumor Suppressor, BCC7, Transformation-Related Protein 53, LFS1, tumor Protein 53, Li-Fraumeni Syndrome, Tumor Suppressor P53; P2X5 (Purinergic receptor P2X ligand-gated ion channel 5, an ion channel gated by extracellular ATP, may be involved in synaptic transmission and neurogenesis, deficiency may contribute to the pathophysiology of idiopathic detrusor instability); 422 aa), al: 7.63, MW: 47206 TM: 1 [P] Gene Chromosome: 17p13.3, Genbank accession No. NP-002552; OGT (0-Linked N-Acetylglucosamine (GlcNAc) Transferase, O-GlcNAc Transferase P110 Subunit, 0-Linked N-Acetylglucosamine (GlcNAc) Transferase (UDP-N-Acetylglucosamine:Polypeptide-N-Acetylglucosaminyl Transferase, UDP-N-Acetylglucosamine-Peptide N-Acetylglucosaminyltransferase 110 KDa Subunit, UDP-N-Acetylglucosamine:Polypeptide-N-Acetylglucosaminyl Transferase, Uridinediphospho-N-Acetylglucosamine:Polypeptide Beta-N-Acetylglucosaminyl Transferase, O-GlcNAc Transferase Subunit P110, EC 2.4.1.255, 0-Linked N-Acetylglucosamine Transferase 110 KDa Subunit, EC 2.4.1, HRNT1, EC 2.4.1.186, 0-GLCNAC; GenBank: AAH38180.1); 0A1 (Osteoarthritis QTL 1, OASD; GenBank: CAA88742.1); NY-ESO-1/LAGE-2 (Cancer/Testis Antigen 1 B, CTAG1 B, NY-ESO-1, LAGE-2, ESO1, CTAG1, CTAG, LAGE2B, Cancer/Testis Antigen 1, Autoimmunogenic Cancer/Testis Antigen NY-ESO-1, Ancer Antigen 3, Cancer/Testis Antigen 6.1, New York Esophageal Squamous Cell Carcinoma 1, L Antigen Family Member 2, LAGE2, CT6.1, LAGE2A; GenBank: AAI30365.1); NY-BR-1 (ANKRD30A, Ankyrin Repeat Domain 30A, Breast Cancer Antigen NY-BR-1, Serologically Defined Breast Cancer Antigen NY-BR-1, Ankyrin Repeat Domain-Containing Protein 30A; NCBI Reference Sequence: NP-443723.2); N-ras (NRAS, Neuroblastoma RAS Viral (V-Ras) Oncogene Homolog, NRAS 1, Transforming Protein N-Ras, GTPase NRas, ALPS4, N-Ras Protein Part 4, NS6, Oncogene Homolog, HRAS1; GenBank: AAH05219.1); NFYC (Nuclear Transcription Factor Y, Gamma, HAP5, HSM, Nuclear Transcription Factor Y Subunit C, Transactivator HSM-1/2, CCAAT Binding Factor Subunit C, NF-YC, CCAAT Transcription Binding Factor Subunit Gamma, CAAT Box DNA-Binding Protein Subunit C, Histone H1 Transcription Factor Large Subunit 2A, CBFC, Nuclear Transcription Factor Y Subunit Gamma, CBF-C, Transactivator HSM-1, H1TF2A, Transcription Factor NF-Y, C Subunit; neo-PAP (PAPOLG, Poly(A) Polymerase Gamma, Neo-Poly(A) Polymerase, Nuclear Poly(A) Polymerase Gamma, Polynucleotide Adenylyltransferase Gamma, SRP RNA 3' Adenylating Enzyme/Pap2, PAP-gamma, Neo-PAP, SRP RNA 3'-Adenylating Enzyme, PAP2, EC 2.7.7.19, PAPG; NCBI Reference Sequence: NP-075045.2); NCA (CEACAM6, Genbank accession no. M1872); Napi3b (NAPI-3B, NPTIIb, SLC34A2, solute carrier family 34 (sodium phosphate), member 2, type II sodium-dependent phosphate transporter 3b, Genbank accession no. NM-00642); Myosin class I; MUM-3; MUM-2 (TRAPPC1, Trafficking Protein Particle Complex 1, BETS, BETS Homolog, MUM2, Melanoma Ubiquitous Mutated 2, Multiple Myeloma Protein 2, Trafficking Protein Particle Complex Subunit 1; MUM-if; Mucin (MUC1, Mucin 1, Cell Surface Associated, PEMT, PUM, CA 15-3, MCKD1, ADMCKD, Medullary Cystic Kidney Disease 1 (Autosomal Dominant), ADMCKD1, Mucin 1, Transmembrane, CD227, Breast Carcinoma-Associated Antigen DF3, MAM6, Cancer Antigen 15-3, MCD, Carcinoma-Associated Mucin, MCKD, Krebs Von Den Lungen-6, MUC-1/SEC, Peanut-Reactive Urinary Mucin, MUC1/ZD, Tumor-Associated Epithelial Membrane Antigen, DF3 Antigen, Tumor-Associated Mucin, episialin, EMA, H23 Antigen, H23AG, Mucin-1, KL-6, Tumor Associated Epithelial Mucin, MUC-1, Episialin, PEM, CD227 Antigen; UniProtKB/Swiss-Prot: P15941.3); MUCSAC (Mucin SAC, Oligomeric Mucus/Gel-Forming, Tracheobronchial Mucin' MUC5, TBM, Mucin 5, Subtypes A And C, Tracheobronchial/Gastric, leB, Gastric Mucin, Mucin SAC, Oligomeric Mucus/Gel-Forming Pseudogene, Lewis B Blood Group Antigen, LeB, Major Airway Glycoprotein, MUC-SAC, Mucin-5 Subtype AC, Tracheobronchial; MUC1 (Mucin 1, Cell Surface Associated, PEMT, PUM, CA 15-3, MCKD1, ADMCKD, Medullary Cystic Kidney Disease 1 (Autosomal Dominant), ADMCKD1, Mucin 1, Transmembrane, CD227, Breast Carcinoma-Associated Antigen DF3, MAM6, Cancer Antigen 15-3, MCD, Carcinoma-Associated Mucin, MCKD, Krebs Von Den Lungen-6, MUC-1/SEC, Peanut-Reactive Urinary Mucin, MUC-1/X, Polymorphic Epithelial Mucin, MUC1/ZD, Tumor-Associated Epithelial Membrane Antigen, DF3 Antigen, Tumor-Associated Mucin, episialin, EMA, h23 Antigen, H23AG, mucin-1, KL-6, Tumor Associated Epithelial Mucin, MUC-1, Episialin, PEM, CD227 Antigen; MSG783 (RNF124, hypothetical protein FLJ20315, Genbank accession no. NM-01776; MRP4-multidrug resistance-associated protein 4 isoform 3, MOAT-B; MOATB [*Homo sapiens*]; NCBI Reference Sequence: NP-001288758.1; MPF (MPF, MSLN, SMR, megakaryocyte potentiating factor, mesothelin, Genbank accession no. NM-00582; MMP-7 (MMP7, matrilysin, MPSL1, matrin, Matrix Metalloproteinase 7 (Matrilysin, Uterine), Uterine Matrilysin, Matrix Metalloproteinase-7, EC 3.4.24.23, Pump-1 Protease, Matrin, Uterine Metalloproteinase, PUMP1, MMP-7, EC 3.4.24, PUMP-1; GenBank: AAC37543.1); MMP-2 (MMP2, Matrix Metallopeptidase 2 (Gelatinase A, 72 kDa Gelatinase, 72 kDa Type IV Collagenase), MONA, CLG4A, Matrix Metalloproteinase 2 (Gelatinase A, 72 kD Gelatinase, 72 kD Type IV Collagenase), CLG4, 72 kDa Gelatinase, 72 kDa Type IV Collagenase), Matrix Metalloproteinase-2, MMP-II, 72 KDa Gelatinase, Collagenase Type IV-A, MMP-2, Matrix Metalloproteinase-II, TBE-1, Neutrophil Gelatinase, EC 3.4.24.24, EC 3.4.24; GenBank: AAH02576.1); and Meloe.

In certain embodiments, the inventive CD3 binding domains and antibodies comprising them comprise a multispecific antibody, for example, a bispecific antibody wherein the multispecific antibody comprises a second binding domain having specificity for a second antigen selected from the group consisting of: 17-IA, 4-1BB, 4Dc, 6-keto-PGF1a, 8-iso-PGF2a, 8-oxo-dG, A1 Adenosine Receptor, A33, ACE, ACE-2, Activin, Activin A, Activin AB, Activin B, Activin C, Activin RIA, Activin RIA ALK-2, Activin RIB ALK-4, Activin RIIA, Activin RUB, ADAM, ADAM10, ADAM12, ADAM15, ADAM17/TACE, ADAM8, ADAM9, ADAMTS, ADAMTS4, ADAMTS5, Addressins, aFGF, ALCAM, ALK, ALK-1, ALK-7, alpha-1-antitrypsin, alpha-V/beta-1 antagonist, ANG, Ang, APAF-1, APE, APJ, APP, APRIL, AR, ARC, ART, Artemin, anti-Id, ASPARTIC, Atrial natriuretic factor, av/b3 integrin, Axl, b2M, B7-1, B7-2, B7-H, B-lymphocyte Stimulator (BlyS), BACE, BACE-1, Bad, BAFF, BAFF-R, Bag-1, BAK, Bax, BCA-1, BCAM, Bel, BCMA, BDNF, b-ECGF, bFGF, BID, Bik, BIM, BLC, BL-CAM, BLK, BMP, BMP-2 BMP-2a, BMP-3 Osteogenin, BMP-4 BMP-2b, BMP-5, BMP-6 Vgr-1, BMP-7 (OP-1), BMP-8 (BMP-8a, OP-2), BMPR, BMPR-IA (ALK-3), BMPR-IB (ALK-6), BRK-2, RPK-1, BMPR-II (BRK-3), BMPs, b-NGF, BOK, Bombesin, Bone-derived neurotrophic factor, BPDE, BPDE-DNA, BTC, complement factor 3 (C3), C3a, C4, C5, C5a, CIO, CA125, CAD-8, Calcitonin, cAMP, carcinoembryonic antigen (CEA), carcinoma-associated antigen, Cathepsin A, Cathepsin B, Cathepsin C/DPPI, Cathepsin D, Cathepsin E, Cathepsin H, Cathepsin L, Cathepsin O, Cathepsin S, Cathepsin V, Cathepsin X/Z/P, CBL, CCI, CCK2, CCL, CCL1, CCL11, CCL12, CCL13, CCL 14, CCL15, CCL16, CCL1 7, CCL18, CCL19, CCL2, CCL20, CCL21, CCL22, CCL23, CCL24, CCL25, CCL26, CCL27, CCL28, CCL3, CCL4, CCL5, CCL6, CCL7, CCL8, CCL9/10, CCR, CCR1, CCR10, CCR10, CCR2, CCR3, CCR4, CCR5, CCR6, CCR7, CCR8, CCR9, CD1, CD2, CD4, CD5, CD6, CD7, CD8, CD10, CD11a, CD11b, CD11c, CD13, CD14, CD15, CD16, CD18, CD19, CD20, CD21, CD22, CD23, CD25, CD27L, CD28, CD29, CD30, CD30L, CD32, CD33 (p67 proteins), CD34, CD38, CD40, CD40L, CD44, CD45, CD46, CD49a, CD52, CD54, CD55, CD56, CD61, CD64, CD66e, CD74, CD80 (B7-1), CD89, CD95, CD123, CD137, CD138, CD140a, CD146, CD147, CD148, CD152, CD164, CEACAM5, CFTR, cGMP, CINC, *Clostridium botulinum* toxin, *Clostridium perfringens* toxin, CKb8-1, CLC, CMV, CMV UL, CNTF, CNTN-1, COX, C-Ret, CRG-2, CT-1, CTACK, CTGF, CTLA-4, CX3CL1, CX3CR1, CXCL, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCR, CXCR1, CXCR2, CXCR3, CXCR4, CXCR5, CXCR6, cytokeratin tumor-associated antigen, DAN, DCC, DcR3, DC-SIGN, Decay accelerating factor, des(1-3)-IGF-I (brain IGF-1), Dhh, digoxin, DNAM-1, Dnase, Dpp, DPPIV/CD26, Dtk, ECAD, EDA, EDA-A1, EDA-A2, EDAR, EGF, EGFR (ErbB-1), EMA, EMMPRIN, EN A, endothelin receptor, Enkephalinase, eNOS, Eot, eotaxin1, EpCAM, Ephrin B2/EphB4, EPO, ERCC, E-selectin, ET-1, Factor Ila, Factor VII, Factor VIIIc, Factor IX, fibroblast activation protein (FAP), Fas, FcRI, FEN-1, Ferritin, FGF, FGF-19, FGF-2, FGF3, FGF-8, FGFR, FGFR-3, Fibrin, FL, FLIP, Flt-3, Flt-4, Follicle stimulating hormone, Fractalkine, FZD1, FZD2, FZD3, FZD4, FZD5, FZD6, FZD7, FZD8, FZD9, FZD10, G250, Gas 6, GCP-2, GCSF, GD2, GD3, GDF, GDF-1, GDF-3 (Vgr-2), GDF-5 (BMP-14, CDMP-1), GDF-6 (BMP-13, CDMP-2), GDF-7 (BMP-12, CDMP-3), GDF-8 (Myostatin), GDF-9, GDF-15 (MIC-1), GDNF, GDNF, GFAP, GFRa-1, GFR-alpha1, GFR-alpha2, GFR-alpha3, GITR, Glucagon, Glut 4, glycoprotein IIb/IIIa (GP IIb/IIIa), GM-CSF, gp130, gp72, GRO, Growth hormone releasing factor, Hapten (NP-cap or NIP-cap), HB-EGF, HCC, HCMV gB envelope glycoprotein, HCMV) gH envelope glycoprotein, HCMV UL, Hemopoietic growth factor (HGF), Hep B gpl20, heparanase, Her2, Her2/neu (ErbB-2), Her3 (ErbB-3), Her4 (ErbB-4), herpes simplex virus (HSV) gB glycoprotein, HSV gD glycoprotein, HGFA, High molecular weight melanoma-associated antigen (HMW-MAA), HIV gpl20, HIV IIIB gp 120 V3 loop, HLA, HLA-DR, HM1.24, HMFG PEM, HRG, Hrk, human cardiac myosin, human cytomegalovirus (HCMV), human growth hormone (HGH), HVEM, 1-309, IAP, ICAM, ICAM-1, ICAM-3, ICE, ICOS, IFNg, Ig, IgA receptor, IgE, IGF, IGF binding proteins, IGF-1R, IGFBP, IGF-I, IGF-II, IL, IL-1, IL-1R, IL-2, IL-2R, IL-4, IL-4R, IL-5, IL-5R, IL-6, IL-6R, IL-8, IL-9, IL-10, IL-12, IL-13, IL-15, IL-18, IL-18R, IL-23, interferon (INF)-alpha, INF-beta, INF-gamma, Inhibin, iNOS, Insulin A-chain, Insulin B-chain, Insulin-like growth factor 1, integrin alpha2, integrin alpha3, integrin alpha4, integrin alpha4/beta1, integrin, alpha4/beta7, integrin alpha5 (alphaV), integrin alpha5/beta1, integrin alpha5/beta3, integrin alpha6, integrin beta1, integrin beta2, interferon gamma, IP-10, 1-TAC, JE, Kallikrein 2, Kallikrein 5, Kallikrein 6, Kallikrein 11, Kallikrein 12, Kallikrein 14, Kallikrein 15, Kallikrein LI, Kallikrein L2, Kallikrein L3, Kallikrein L4, KC, KDR, Keratinocyte Growth Factor (KGF), laminin 5, LAMP, LAP, LAP (TGF-1), Latent TGF-1, Latent TGF-1 bpl, LBP, LDGF, LECT2, Lefty, Lewis-Y antigen, Lewis-Y related antigen, LFA-1, LFA-3, Lfo, LIF, LIGHT, lipoproteins, LIX, LKN, Lptn, L-Selectin, LT-a, LT-b, LTB4, LTBP-1, Lung surfactant, Luteinizing hormone, Lymphotoxin Beta Receptor, Mac-1, MAdCAM, MAG, MAP2, MARC, MCAM, MCAM, MCK-2, MCP, M-CSF, MDC, Mer, MET-ALLOPROTEASES, MGDF receptor, MGMT, MHC (HLA-DR), MIF, MIG, MIP, MIP-1-alpha, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, MPIF, Mpo, MSK, MSP, mucin (Mucl), MUC18, Muellerian-inhibitin substance, Mug, MuSK, NAIP, NAP, NCAD, N-Cadherin, NCA 90, NCAM, NCAM, Neprilysin, Neurotrophin-3, -4, or -6, Neurturin, Neuronal growth factor (NGF), NGFR, NGF-beta, nNOS, NO, NOS, Npn, NRG-3, NT, NTN, OB, OGG1, OPG, OPN, OSM, OX40L, OX40R, p150, p95, PADPr, Parathyroid hormone, PARC, PARP, PBR, PBSF, PCAD, P-Cadherin, PCNA, PDGF, PDGF, PDK-1, PECAM, PEM, PF4, PGE, PGF, PGI2, PGJ2, PIN, PLA2, placental alkaline phosphatase (PLAP), P1GF, PLP, PP14, Proinsulin, Prorelaxin, Protein C, PS, PSA, PSCA, prostate specific membrane antigen (PSMA), PTEN, PTHrp, Ptk, PTN, R51, RANK, RANKL, RANTES, RANTES, Relaxin A-chain, Relaxin B-chain, renin, respiratory syncytial virus (RSV) F, RSV Fgp, Ret, Rheumatoid factors, RLIP76, RPA2, RSK, S100, SCF/KL, SDF-1, SERINE, Serum albumin, sFRP-3, Shh, SIGIRR, SK-1, SLAM, SLPI, SMAC, SMDF, SMOH, SOD, SPARC, Stat, STEAP, STEAP-II, TACE, TACI, TAG-72 (tumor-associated glycoprotein-72), TARC, TCA-3, T-cell receptors (e.g., T-cell receptor alpha/beta), TdT, TECK, TEM1, TEM5, TEM7, TEM8, TERT, testicular PLAP-like alkaline phosphatase, TfR, TGF, TGF-alpha, TGF-beta, TGF-beta Pan Specific, TGF-beta RI (ALK-5), TGF-beta RII, TGF-beta Rllb, TGF-beta RIII, TGF-beta1, TGF-beta2, TGF-beta3, TGF-beta4, TGF-beta5, Thrombin, Thymus Ck-1, Thyroid stimulating hormone, Tie, TIMP, TIQ, Tissue Factor, TMEFF2, Tmpo, TMPRSS2, TNF, TNF-alpha, TNF-alpha beta, TNF-beta2, TNFc, TNF-RI, TNF-RII, TNFRSF10A (TRAIL R1 Apo-2, DR4), TNFRSFIOB (TRAIL R2 DR5, KILLER, TRICK-2A, TRICK-B), TNFRSF10C (TRAIL R3 DcRI, LIT, TRID), TNFRSF10D (TRAIL R4 DcR2, TRUNDD), TNFRSF11A (RANK ODF R, TRANCE R), TNFRSF11B (OPG OCIF, TR1), TNFRSF12 (TWEAK R FN14), TNFRSF13B (TACI), TNFRSF13C (BAFF R), TNFRSF14 (HVEM ATAR, HveA, LIGHT R, TR2), TNFRSF16 (NGFR p75NTR), TNFRSF17 (BCMA), TNFRSF18 (GITR AITR), TNFRSF19 (TROY TAJ, TRADE), TNFRSF19L (RELT), TNFRSFIA (TNF RI CD120a, p55-60), TNFRSFIB (TNF RII CD120b, p75-80), TNFRSF26 (TNFRH3), TNFRSF3 (LTbR TNF RIII, TNFC R), TNFRSF4 (OX40 ACT35, TXGP1 R), TNFRSF5 (CD40 p50), TNFRSF6 (Fas Apo-1, APT1, CD95), TNFRSF6B (DcR3 M68, TR6), TNFRSF7 (CD27), TNFRSF8 (CD30), TNFRSF9 (4-1BB CD137, ILA), TNFRSF21 (DR6), TNFRSF22 (DcTRAIL R2 TNFRH2), TNFRST23 (DcTRAIL R1 TNFRH1), TNFRSF25 (DR3 Apo-3, LARD, TR-3, TRAMP, WSL-1), TNFSF10 (TRAIL Apo-2 Ligand, TL2), TNFSF11 (TRANCE/RANK Ligand ODF, OPG Ligand), TNFSF12 (TWEAK Apo-3 Ligand, DR3 Ligand), TNFSF13 (APRIL TALL2), TNFSF13B (BAFF BLYS, TALL1, THANK, TNFSF20), TNFSF14 (LIGHT HVEM Ligand, LTg), TNFSF15 (TL1A/VEGI), TNFSF18 (GITR Ligand AITR Ligand, TL6), TNFSFIA (TNF-a Conectin, DIF, TNFSF2), TNFSF1B (TNF-b LTa, TNFSF1), TNFSF3 (LTb TNFC, p33), TNFSF4 (OX40 Ligand gp34, TXGP1), TNFSF5 (CD40 Ligand CD154, gp39, HIGM1, IMD3, TRAP), TNFSF6 (Fas Ligand Apo-1 Ligand, APT1 Ligand), TNFSF7 (CD27 Ligand CD70), TNFSF8 (CD30 Ligand CD153), TNFSF9 (4-1BB Ligand CD137 Ligand), TP-1, t-PA, Tpo, TRAIL, TRAIL R, TRAIL-R1, TRAIL-R2, TRANCE, transferring receptor, TRF, Trk, TROP-2, TSG, TSLP, tumor-associated antigen CA 125, tumor-associated antigen expressing Lewis Y related carbohydrate, TWEAK, TXB2, Ung, uPAR, uPAR-1, Urokinase, VCAM, VCAM-1, VECAD, VE-Cadherin, VE-cadherin-2, VEFGR-1 (flt-1), VEGF, VEGFR, VEGFR-3 (flt-4), VEGI, VIM, Viral antigens, VLA, VLA-1, VLA-4, VNR integrin, von Willebrands factor, WIF-1, WNT1, WNT2, WNT2B/13, WNT3, WNT3A, WNT4, WNT5A, WNT5B, WNT6, WNT7A, WNT7B, WNT8A, WNT8B, WNT9A, WNT9A, WNT9B, WNT10A, WNT10B, WNT11, WNT16, XCL1, XCL2, XCR1, XCR1, XEDAR, XIAP, XPD, CTLA4 (cytotoxic T lymphocyte antigen-4), PD1 (programmed cell death protein 1), PD-L1 (programmed cell death ligand 1), LAG-3 (lymphocyte activation gene-3), TIM-3 (T cell immunoglobulin and mucin protein-3), receptors for hormones, and growth factors.

In certain embodiments, the inventive CD3 binding domains and antibodies comprising them comprise a multispecific antibody, for example, a bispecific antibody wherein the multispecific antibody comprises a second binding domain having specificity for a second antigen selected from the group consisting of: BCMA, CTLA4 (cytotoxic T lymphocyte antigen-4), PD1 (programmed cell death protein 1), PD-L1 (programmed cell death ligand 1), LAG-3 (lymphocyte activation gene-3), TIM-3, CD20, CD2, CD19, Her2, EGFR, EpCAM, FcyRIIIa (CD16), FcyRIIa (CD32a), FcyRIIb (CD32b), FcyRI (CD64), Toll-like receptors (TLRs), TLR4, TLR9, cytokines, IL-2, IL-5, IL-13, IL-6, IL-17, IL-12, IL-23, TNFa, TGFb, cytokine receptors, IL-2R, chemokines, chemokine receptors, growth factors, VEGF, and HGF.

In certain embodiments, the inventive CD3 binding domains and antibodies comprising them comprise at least a second antigen binding domain that specifically binds to an antigen, wherein said antibody comprises a multispecific format selected from the group consisting of: Fab-Fc-scFv, "bottle-opener", Mab-scFv, Mab-Fv, Dual scFv, central Fv, central scFv, one-arm central scFv, Fab-Fab, Fab-Fv, mAb-Fv, mAb-Fab, DART, BiTE, common light chain-IgG, TandAb, Cross-Mab, SEED, BEAT, TrioMab, and DuetMab.

In certain embodiments are provided isolated nucleic acid sequences encoding the inventive CD3 binding domains and antibodies comprising them.

In certain embodiments are provided expression vectors comprising nucleic acid sequences encoding the inventive CD3 binding domains and antibodies comprising them.

In certain embodiments are provided host cells transfected, transformed, or transduced with a nucleic acid sequences encoding the inventive CD3 binding domains and antibodies comprising them.

In certain embodiments are provided host cells transfected, transformed, or transduced with vectors encoding the inventive CD3 binding domains and antibodies comprising them.

In certain embodiments are provided pharmaceutical compositions comprising one or more of the inventive CD3 binding domains and antibodies comprising them.

In certain embodiments are provided pharmaceutical compositions comprising one or more of the inventive CD3 binding domains and antibodies comprising them and a pharmaceutically acceptable carrier and/or excipient.

In certain embodiments are provided pharmaceutical compositions comprising one or more nucleic acids encoding one or more of the inventive CD3 binding domains and antibodies comprising them.

In certain embodiments are provided pharmaceutical compositions comprising one or more vectors encoding one or more of the inventive CD3 binding domains and antibodies comprising them and a pharmaceutically acceptable carrier and/or excipient.

In certain embodiments are provided methods of treating or delaying the progression of a disorder in a mammal in need of such treating, the methods comprising administering one or more of the inventive CD3 binding domains and antibodies comprising them, wherein the disorder is decreased or ameliorated as a result of said administering. In certain embodiments are provided methods of preventing or decreasing risk of developing a disorder in a mammal by administering one or more of the inventive CD3 binding domains and antibodies comprising them, wherein the disorder is prevented as a result of said administering. In certain embodiments are provided methods of treating a disorder in a mammal in need of such treating, wherein the disorder comprises a proliferative disorder, an oncological disorder, an immuno-oncological disorder, a neurological disorder, a neurodegenerative disorder, or an autoimmune disorder, comprising administering one or more of the inventive CD3 binding domains and antibodies comprising them, wherein the disorder is decreased or ameliorated as a result of said administering. In certain embodiments such methods further comprise administering to the mammal an additional therapeutic agent. In certain embodiments such mammal is a human.

In certain embodiments is provided a heterodimeric CD3 fusion protein comprising: a first polypeptide chain comprising a CD3 epsilon polypeptide fused to a first Fc region; and a second polypeptide chain comprising CD3 delta polypeptide fused to a second Fc region. In certain embodiments, the CD3 epsilon polypeptide comprises a human CD3 epsilon polypeptide and the CD3 delta polypeptide comprises a human CD3 delta polypeptide. In certain embodiments, the CD3 epsilon polypeptide is a human CD3 epsilon polypeptide and the CD3 delta polypeptide is a human CD3 delta polypeptide. In certain embodiments, the CD3 epsilon polypeptide comprises a cynomolgus CD3 epsilon polypeptide and the CD3 delta polypeptide comprises a cynomolgus CD3 delta polypeptide. In certain embodiments the CD3 epsilon polypeptide is a cynomolgus CD3 epsilon polypeptide and the CD3 delta polypeptide is a cynomolgus CD3 delta polypeptide. In certain embodiments the first polypeptide of the heterodimeric CD3 fusion protein comprises the following amino acid sequence: QDGNEEMGGITQTPYKVSISGTTVILTCPQYPG-SEILWQHNDKNIGGDEDDKNIGSDEDH LSLKEFSELEQSGYYVCYPRGSKPEDANFYLYL-RARVCENCMEMDGGSDKTHTCPPCP APELLGGPSVFLFPPKPKDTLMISRTPE-VTCVVVDVSHEDPEVKFNWYVDGVEVHNAKT KPRE-EQYASTYRVVSVLTVLHQDWLNGKEYKCKVSNKA-LPAPIEKTISKAKGQPREPQV YTLPPSRDELT-KNQVSLTCLVKGFYPSDIAVEWESNGQPENNYKTTPP VLDSDGSFFLYS KLTVDKSRWQQGNVFSCSVMHEALHNHYTQKSLSL-SPGK (SEQ ID NO: 6716); and the second polypeptide chain comprises the following amino acid sequence: FKIP-IEELEDRVFVNCNTSITWVEGTVGTLLSDITRLD-LGKRILDPRGIYRCNGTDIYKDKE STVQVHY-RMCQSCVELDGGSDKTHTCPPCPAPELLGGPSVFLFP PKPKDTLMISRTPEVT CVVVDVSHEDPE-VKFNWYVDGVEVHNAKTKPRE-EQYASTYRVVSVLTVLHQDWLNG KEYKCKVSNKA-LPAPIEKTISKAKGQPREPQVYTLPPSRDELTKNQVSL TCLVKGFYPSD IAVEWESNGQPEN-NYKTTPPVLDSDGSFFLYSK-LTVDKSRWQQGNVFSCSVMHEALHN HYTQKSLSL-SPGK (SEQ ID NO: 6717). In certain embodiments the first polypeptide of the heterodimeric CD3 fusion protein comprises the following amino acid sequence: QDGNEEMGSITQTPYQVSISGTTVILTCSQHLGSEA-QWQHNGKNKEDSGDRLFLPEFSE MEQSGYYVCY-PRGSNPEDASHHLYLKARVCENCMEMDGGSDKTH-TCPPCPAPELLGGP SVFLFPPKPKDTLMISRTPEVTCVVVDVSHEDPE-VKFNWYVDGVEVHNAKTKPREEQY ASTYRVVSVLTVLHQDWLNGKEYKCKVSNKALPA-PIEKTISKAKGQPREPQVYTLPPSR DELTKNQVSLT-CLVKGFYPSDIAVEWESNGQPEN-NYKTTPPVLDSDGSFFLYSKLTVDK SRWQQGNVFSCSVMHEALHNHYTQKSLSLSPGK (SEQ ID NO: 6718); and the second polypeptide chain comprises the following amino acid sequence: FKIPVEELEDRVFVKCNTSVTWVEGTVGTLLLTNN-TRLDLGKRILDPRGIYRCNGTDIYKD KESAVQVHY-RMCQNCVELDPGSDKTHTCPPCPA-PELLGGPSVFLFPPKPKDTLMISRTPE VTCVVVDVSHEDPE-VKFNWYVDGVEVHNAKTKPRE-EQYASTYRVVSVLTVLHQDWL NGKEYKCKVSNKA-LPAPIEKTISKAKGQPREPQVYTLPPSRDELTKNQVS LTCLVKGFYP SDIAVEWESNGQPEN-NYKTTPPVLDSDGSFFLYSK-LTVDKSRWQQGNVFSCSVMHEAL HNHYTQKSLSL-SPGK (SEQ ID NO: 6719). In certain embodiments are provided uses of such heterodimeric CD3 fusion proteins in identifying, isolating, selecting, generating, and/or characterizing CD3 binding domains and antibodies comprising them.

BRIEF DESCRIPTION OF THE DRAWINGS

FIG. 1 shows an exemplary immunization strategy.

FIG. 8 shows exemplary competitive binding assay results showing that all CD3 epsilon-binding clones bound to epitopes overlapping that of I2C and did not compete significantly with OKT3.

FIGS. 10A-10D show exemplary humanized variants generated for each clone (SEQ ID NOs: 6602-6679) (A) and exemplary cell binding profiles for ADI-15512 (B), ADI-16513 (C), and ADI-16516 (D).

FIG. 13 shows exemplary sequences of humanized clones selected for optimization and their respective parents (SEQ ID NOs: 6680-6695).

FIG. 19 shows an exemplary H3 NNK diversification scheme (SEQ ID NOs: 6702-6734 left column, and SEQ ID NOs: 6735-6767 right column).

FIG. 22 shows exemplary data and sequences (SEQ ID NOs: 6768-6780) used for generation of combinatorially combined variants based on mutations observed in five selected clones (SEQ ID NOs: 7032-7036).

FIGS. 23A-23B show an exemplary depiction of potential degradation motifs (SEQ ID NOs: 6786-6806) (A), and an exemplary comparison of ADI-22523 (all four sequence liability sites) to individual VH Ala substitutions (B).

FIG. 24 shows an exemplary ADI-21978 mutagenesis progeny (SEQ ID NOs: 6807-6828 left column, and SEQ ID NOs: 6829-6844 right column).

FIG. 27 shows an exemplary panel of humanization designs produced in yeast (SEQ ID NOs: 6852-6862).

FIGS. 28A-28D show an exemplary schematic of a selection procedure (A), an exemplary flow cytometry selection plot (B), exemplary Vλ, and VH mutagenesis affinity pressured output sequencing (SEQ ID NOs:6863-6880 top table, and SEQ ID NOs: 6881-6889 bottom table) (C), and Vλ, and VH mutagenesis thermal pressured output sequencing (SEQ ID NOs: 6890-6921 top table, SEQ ID NOs: 6922-6932 bottom table) (D).

FIGS. 29A-29B show an exemplary chain shuffle and mutagenesis library scheme (A), and exemplary cycle 2 optimization-binding and developability profile data (B).

FIG. 30 shows an exemplary matrix with 28 rationally-designed LC (SEQ ID NOs: 6933-6961).

FIG. 31 shows an exemplary depiction of potential degradation motifs (SEQ ID NOs: 6962-6971).

FIG. 32 shows exemplary ADI-21952 mutagenesis progeny (SEQ ID NOs: 6972-7001 left column, and SEQ ID NOs: 7002-7011 right column).

FIGS. 35A-35B show exemplary binding and developability profile data for SEQ ID NOs: 7012-7034 (A), and exemplary degradation propensity data (B).

DETAILED DESCRIPTION OF THE INVENTION

Unless defined otherwise, all technical and scientific terms used herein have the same meaning as commonly understood by one of ordinary skill in the art to which this invention belongs. As used herein, the term "about," when used in reference to a particular recited numerical value, means that the value may vary from the recited value by no more than 1%. For example, as used herein, the expression "about 100" includes 99 and 101 and all values in between (e.g., 99.1, 99.2, 99.3, 99.4, etc.).

It is understood that aspects and embodiments of the invention described herein include "comprising," "consisting," and "consisting essentially of" aspects and embodiments.

Figure 18:
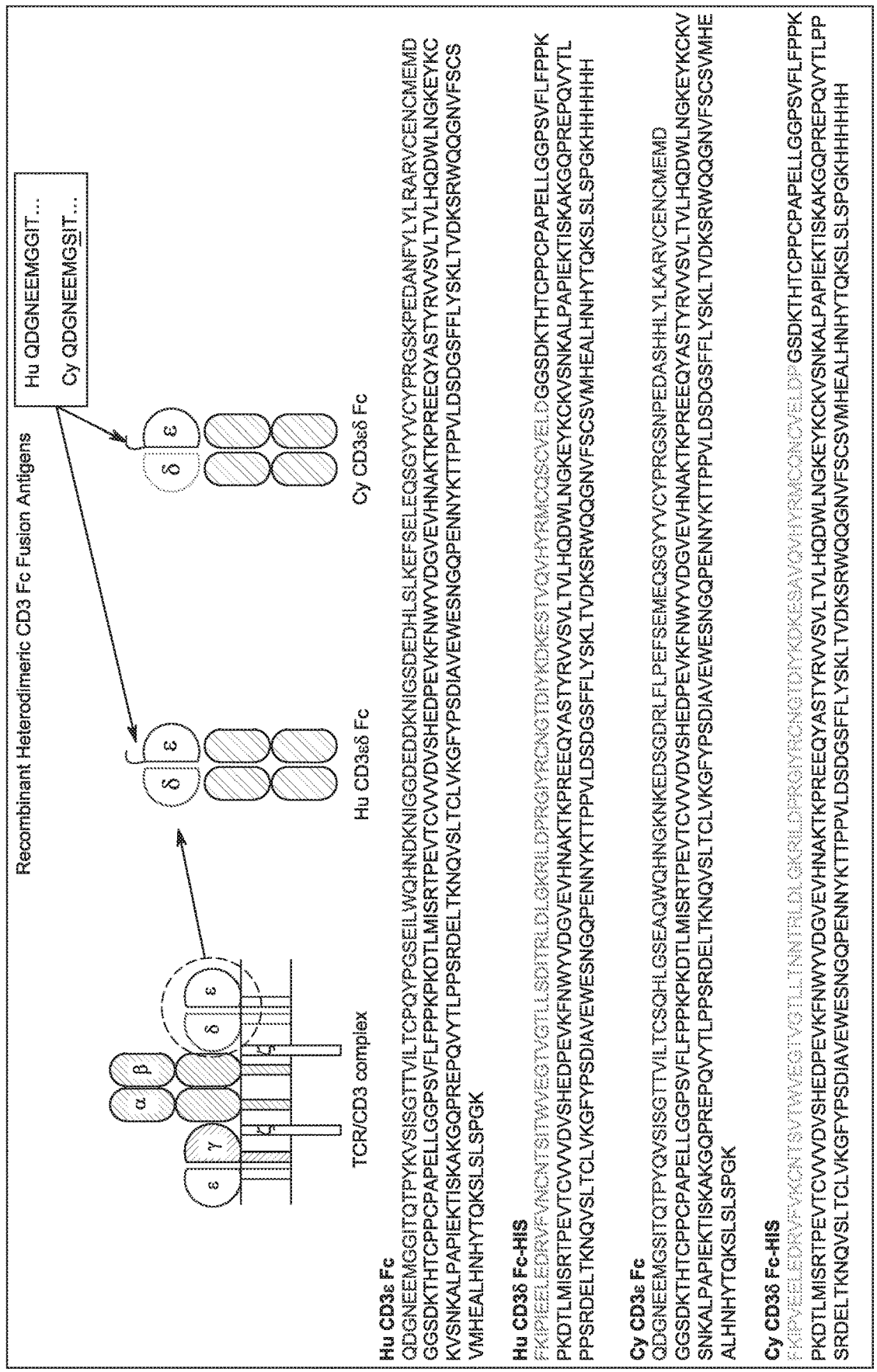
FIG. 18 shows exemplary recombinant heterodimeric CD3 Fc fusion antigens Hu CD3εFc (SEQ ID NO: 6698), Hu CD3δFc-H|S (SEQ ID NO: 6699), Cy CD3εFc (SEQ ID NO: 6700), and Cy CD3δFc-H|S (SEQ ID NO: 6701). Exemplary sequence differences between Hu and Cy CD3 are also shown (SEQ ID NOs: 6696-6697).

"Cluster of Differentiation 3" or "CD3", generally refers to any native CD3 from any vertebrate source, including mammals such as primates (e.g., humans) and rodents (e.g., mice and rats), unless otherwise indicated, including, for example, CD3ε, CD3γ, CD3α, and CD3β chains. The term encompasses "full-length," unprocessed CD3 (e.g., unprocessed or unmodified CD3ε or CD3γ), as well as any form of CD3 that results from processing in the cell. The term also encompasses naturally occurring variants of CD3, including, for example, splice variants or allelic variants. CD3 includes, for example, human CD3ε protein (NCBI RefSeq No. NP_000724), which is 207 amino acids in length, and human CD3γ protein (NCBI RefSeq No. NP_000064), which is 182 amino acids in length. The term also refers to either the human or cynomolgus CD3 epsilon protein, the amino acid sequence for which is depicted, for example in FIG. 18 herein. "CD3εN27" and "CD3εN13" refer to the N-terminal 27 amino acids and the N-terminal 13 amino acids, respectively, of CD3, and optionally containing chemical modifications or cojugations made thereto.

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g., IgG$_1$, IgG$_2$, IgG$_3$, IgG$_4$, IgA$_1$, and IgA$_2$. The heavy chain constant domains that correspond to the different classes of immunoglobulins are called α, δ, ε, γ, and μ, respectively.

The term "cytotoxic agent" as used herein refers to a substance that inhibits or prevents a cellular function and/or causes cell death or destruction. Cytotoxic agents include, but are not limited to, radioactive isotopes (e.g., At$^{211}$, I$^{131}$, I$^{125}$, Y$^{90}$, Re$^{186}$, Re$^{88}$, Sm$^{153}$, Bi$^{212}$, P$^{32}$, Pb$^{212}$ and radioactive isotopes of Lu); chemotherapeutic agents or drugs (e.g., methotrexate, adriamicin, vinca alkaloids (vincristine, vinblastine, etoposide), doxorubicin, melphalan, mitomycin C, chlorambucil, daunorubicin or other intercalating agents); growth inhibitory agents; enzymes and fragments thereof such as nucleolytic enzymes; antibiotics; toxins such as small molecule toxins or enzymatically active toxins of bacterial, fungal, plant or animal origin, including fragments and/or variants thereof; and the various antitumor or anticancer agents disclosed below.

A "disorder" refers to any condition or disease that would benefit from treatment including, but not limited to, chronic and acute disorders or diseases including those pathological conditions which predispose a mammal to the disorder in question.

The terms "cell proliferative disorder" and "proliferative disorder" refer to disorders that are associated with some degree of abnormal cell proliferation. In one embodiment, the cell proliferative disorder comprises cancer. In one embodiment, the cell proliferative disorder comprises a tumor.

The terms "cancer" and "cancerous" refer to or describe the physiological condition in mammals that is typically characterized by unregulated cell growth. Examples of cancer include but are not limited to, carcinoma, lymphoma, blastoma, sarcoma, and leukemia or lymphoid malignancies. More particular examples of such cancers include, but not limited to, squamous cell cancer (e.g., epithelial squamous cell cancer), lung cancer including small-cell lung cancer, non-small cell lung cancer, adenocarcinoma of the lung and squamous carcinoma of the lung, cancer of the peritoneum, hepatocellular cancer, gastric or stomach cancer including gastrointestinal cancer and gastrointestinal stromal cancer, pancreatic cancer, glioblastoma, cervical cancer, ovarian cancer, liver cancer, bladder cancer, cancer of the urinary tract, hepatoma, breast cancer, colon cancer, rectal cancer, colorectal cancer, endometrial or uterine carcinoma, salivary gland carcinoma, kidney or renal cancer, prostate cancer, vulval cancer, thyroid cancer, hepatic carcinoma, anal carcinoma, penile carcinoma, melanoma, superficial spreading melanoma, lentigo maligna melanoma, acral lentiginous melanomas, nodular melanomas, multiple myeloma and B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia); chronic lymphocytic leukemia (CLL); acute lymphoblastic leukemia (ALL); hairy cell leukemia; chronic myeloblastic leukemia; and post-transplant lymphoproliferative disorder (PTLD), as well as abnormal vascular proliferation associated with phakomatoses, edema (such as that associated with brain tumors), Meigs' syndrome, brain, as well as head and neck cancer, and associated metastases. In certain embodiments, cancers that are amenable to treatment by the antibodies of the invention include breast cancer, colorectal cancer, rectal cancer, non-small cell lung cancer, glioblastoma, non-Hodgkins lymphoma (NHL), renal cell cancer, prostate cancer, liver cancer, pancreatic cancer, soft-tissue sarcoma, kaposi's sarcoma, carcinoid carcinoma, head and neck cancer, ovarian cancer, mesothelioma, and multiple myeloma. In some embodiments, the cancer is selected from: small cell lung cancer, gliblastoma, neuroblastomas, melanoma, breast carcinoma, gastric cancer, colorectal cancer (CRC), and hepatocellular carcinoma. Yet, in some embodiments, the cancer is selected from:

non-small cell lung cancer, colorectal cancer, glioblastoma and breast carcinoma, including metastatic forms of those cancers. In other embodiments, the cancer is selected from a class of mature B-Cell cancers excluding Hodgkin's Lymphoma but including germinal-center B-cell-like (GCB) DLBCL, activated B-cell-like (ABC) DLBCL, follicular lymphoma (FL), mantle cell lymphoma (MCL), acute myeloid leukemia (AML), chronic lymphoid leukemia (CLL), marginal zone lymphoma (MZL), small lymphocytic leukemia (SLL), lymphoplasmacytic lymphoma (LL), Waldenstrom macroglobulinemia (WM), central nervous system lymphoma (CNSL), Burkitt's lymphoma (BL), B-cell prolymphocytic leukemia, Splenic marginal zone lymphoma, Hairy cell leukemia, Splenic lymphoma/leukemia, unclassifiable, Splenic diffuse red pulp small B-cell lymphoma, Hairy cell leukemia variant, Waldenstrom macroglobulinemia, Heavy chain diseases, a Heavy chain disease, γ Heavy chain disease, μ Heavy chain disease, Plasma cell myeloma, Solitary plasmacytoma of bone, Extraosseous plasmacytoma, Extranodal marginal zone lymphoma of mucosa-associated lymphoid tissue (MALT lymphoma), Nodal marginal zone lymphoma, Pediatric nodal marginal zone lymphoma, Pediatric follicular lymphoma, Primary cutaneous follicle centre lymphoma, T-cell/histiocyte rich large B-cell lymphoma, Primary DLBCL of the CNS, Primary cutaneous DLBCL, leg type, EBV-positive DLBCL of the elderly, DLBCL associated with chronic inflammation, Lymphomatoid granulomatosis, Primary mediastinal (thymic) large B-cell lymphoma, Intravascular large B-cell lymphoma, ALK-positive large B-cell lymphoma, Plasmablastic lymphoma, Large B-cell lymphoma arising in HHV8-associated multicentric Castleman disease, Primary effusion lymphoma: B-cell lymphoma, unclassifiable, with features intermediate between diffuse large B-cell lymphoma and Burkitt lymphoma, and B-cell lymphoma, unclassifiable, with features intermediate between diffuse large B-cell lymphoma and classical Hodgkin lymphoma.

The term "tumor" as used herein, refers to all neoplastic cell growth and proliferation, whether malignant or benign, and all pre-cancerous and cancerous cells and tissues. The terms "cancer", "cancerous", "cell proliferative disorder", "proliferative disorder" and "tumor" are not mutually exclusive as referred to herein.

The term "tumor antigen" as used herein, may be understood as those antigens that are presented on tumor cells. These antigens can be presented on the cell surface with an extracellular part, which is often combined with a transmembrane and cytoplasmic part of the molecule. These antigens can sometimes be presented only by tumor cells and never by the normal ones. Tumor antigens can be exclusively expressed on tumor cells or might represent a tumor specific mutation compared to normal cells. In this case, they are called tumor-specific antigens. More common are tumor antigens that are presented by tumor cells and normal cells, and they are called tumor-associated antigens. These tumor-associated antigens can be overexpressed compared to normal cells or are accessible for antibody binding in tumor cells due to the less compact structure of the tumor tissue compared to normal tissue.

The term "$EC_{50}$" refers to the "half maximal effective concentration", which value measures the effectiveness of compound (e.g. an anti-CD3 bonding domain-comprising antibody) towards a biological or biochemical utility. This quantitative measure indicates the quantity or concentration required for a particular compound or antibody to elicit a given biological process to half of the maximal response.

"Effector functions" refer to those biological activities attributable to the Fc region of an antibody, which vary with the antibody isotype. Examples of antibody effector functions include: C1q binding and complement dependent cytotoxicity (CDC); Fc receptor binding; antibody-dependent cell-mediated cytotoxicity (ADCC); phagocytosis; down regulation of cell surface receptors (e.g., B cell receptor); and B cell activation.

An "effective amount" of a compound, for example, an anti-CD3 antibody of the invention or a composition (e.g., pharmaceutical composition) thereof, is at least the minimum amount required to achieve the desired therapeutic or prophylactic result, such as a measurable improvement or prevention of a particular disorder (e.g., a cell proliferative disorder, e.g., cancer). An effective amount herein may vary according to factors such as the disease state, age, sex, and weight of the patient, and the ability of the antibody to elicit a desired response in the individual. An effective amount is also one in which any toxic or detrimental effects of the treatment are outweighed by the therapeutically beneficial effects. For prophylactic use, beneficial or desired results include results such as eliminating or reducing the risk, lessening the severity, or delaying the onset of the disease, including biochemical, histological and/or behavioral symptoms of the disease, its complications and intermediate pathological phenotypes presenting during development of the disease. For therapeutic use, beneficial or desired results include clinical results such as decreasing one or more symptoms resulting from the disease, increasing the quality of life of those suffering from the disease, decreasing the dose of other medications required to treat the disease, enhancing effect of another medication such as via targeting, delaying the progression of the disease, and/or prolonging survival. In the case of cancer or tumor, an effective amount of the drug may have the effect in reducing the number of cancer cells; reducing the tumor size; inhibiting (i.e., slow to some extent or desirably stop) cancer cell infiltration into peripheral organs; inhibit (i.e., slow to some extent and desirably stop) tumor metastasis; inhibiting to some extent tumor growth; and/or relieving to some extent one or more of the symptoms associated with the disorder. An effective amount can be administered in one or more administrations. For purposes of this invention, an effective amount of drug, compound, or pharmaceutical composition is an amount sufficient to accomplish prophylactic or therapeutic treatment either directly or indirectly. As is understood in the clinical context, an effective amount of a drug, compound, or pharmaceutical composition may or may not be achieved in conjunction with another drug, compound, or pharmaceutical composition. Thus, an "effective amount" may be considered in the context of administering one or more therapeutic agents, and a single agent may be considered to be given in an effective amount if, in conjunction with one or more other agents, a desirable result may be or is achieved.

The term "Fc region" herein is used to define a C-terminal region of an immunoglobulin heavy chain that contains at least a portion of the constant region. The term includes native sequence Fc regions and variant Fc regions. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

"Framework" or "FR" refers to variable domain residues other than complementary determining region (CDR) residues. The FR of a variable domain generally consists of four FR domains: FR1, FR2, FR3, and FR4. Accordingly, the CDR and FR sequences generally appear in the following sequence in VH (or VL): FR1-H1(L1)-FR2-H2(L2)-FR3-H3 (L3)-FR4.

The terms "full-length antibody," "intact antibody," and "whole antibody" are used herein interchangeably to refer to an antibody having a structure substantially similar to a native antibody structure or having heavy chains that contain an Fc region as defined herein.

A "growth inhibitory agent" when used herein refers to a compound or composition which inhibits growth of a cell either in vitro or in vivo. In one embodiment, growth inhibitory agent is growth inhibitory antibody that prevents or reduces proliferation of a cell expressing an antigen to which the antibody binds. In another embodiment, the growth inhibitory agent may be one which significantly reduces the percentage of cells in S phase. Examples of growth inhibitory agents include agents that block cell cycle progression (at a place other than S phase), such as agents that induce G1 arrest and M-phase arrest. Classical M-phase blockers include the vincas (vincristine and vinblastine), taxanes, and topoisomerase II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in Mendelsohn and Israel, eds., The Molecular Basis of Cancer, Chapter 1, entitled "Cell cycle regulation, oncogenes, and antineoplastic drugs" by Murakami et al. (W.B. Saunders, Philadelphia, 1995), e.g., p. 13. The taxanes (paclitaxel and docetaxel) are anticancer drugs both derived from the yew tree. Docetaxel (TAXOTERE®, RHONE-POULENC RORER), derived from the European yew, is a semisynthetic analogue of paclitaxel (TAXOL®, BRISTOL-MYERS SQUIBB). Paclitaxel and docetaxel promote the assembly of microtubules from tubulin dimers and stabilize microtubules by preventing depolymerization, which results in the inhibition of mitosis in cells.

A phrase that includes an antigen and the term, "-positive", such as "HER2-positive", means that a disease, condition, or disorder is characterized, inter alia, by higher than normal levels of the referenced antigen or target. In certain embodiments, the antigen or target comprises a moiety that is expressed or otherwise present on cancer cells at a level that is higher than on normal cells.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

A "human antibody" is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues. Human antibodies can be produced using various techniques known in the art, including phage-display libraries. Hoogenboom and Winter, J. Mol. Biol., 227:381 (1991); Marks et al., J. Mol. Biol., 222:581 (1991). Also available for the preparation of human monoclonal antibodies are methods described in Cole et al., Monoclonal Antibodies and Cancer Therapy, Alan R. Liss, p. 77 (1985); Boerner et al., J. Immunol. 147(1):86-95 (1991). See also van Dijk and van de Winkel, Curr. Opin. Pharmacol., 5: 368-74 (2001). Human antibodies can be prepared by administering the antigen to a transgenic animal that has been modified to produce such antibodies in response to antigenic challenge, but whose endogenous loci have been disabled, e.g., immunized xenomice (see, e.g., U.S. Pat. Nos. 6,075,181 and 6,150,584 regarding XENOMOUSE technology). See also, for example, Li et al., Proc. Natl. Acad. Sci. USA, 103: 3557-3562 (2006) regarding human antibodies generated via a human B-cell hybridoma technology. The term "human antibody", as used herein, is intended to include antibodies having variable and constant regions derived from human germline immunoglobulin sequences. The human mAbs of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include mAbs in which CDR sequences derived from the germline of another mammalian species (e.g., mouse), have been grafted onto human FR sequences.

A "human consensus framework" is a framework which represents the most commonly occurring amino acid residues in a selection of human immunoglobulin VL or VH framework sequences. Generally, the selection of human immunoglobulin VL or VH sequences is from a subgroup of variable domain sequences. Generally, the subgroup of sequences is a subgroup as in Kabat et al., Sequences of Proteins of Immunological Interest, Fifth Edition, NIH Publication 91-3242, Bethesda Md. (1991), vols. 1-3. In one embodiment, for the VL, the subgroup is subgroup kappa I as in Kabat et al., supra. In one embodiment, for the VH, the subgroup is subgroup III as in Kabat et al., supra.

A "humanized antibody" refers to an antibody comprising amino acid residues from non-human CDRs and amino acid residues from human FRs. In certain embodiments, a humanized antibody will comprise substantially all of at least one, and typically two, variable domains, in which all or substantially all of the (e.g., CDRs) correspond to those of a non-human antibody, and all or substantially all of the FRs correspond to those of a human antibody. A humanized antibody optionally may comprise at least a portion of an antibody constant region derived from a human antibody. A humanized form of an antibody, e.g., a non-human antibody, refers to an antibody that has undergone humanization.

An "immunoconjugate" is an antibody conjugated to one or more heterologous molecule(s), including but not limited to a cytotoxic agent.

A "subject" or an "individual" is a mammal. Mammals include, but are not limited to, domesticated animals (e.g., cows, sheep, cats, dogs, and horses), primates (e.g., humans and non-human primates such as monkeys), rabbits, and rodents (e.g., mice and rats). In certain embodiments, the subject or individual is a human.

An "isolated antibody" is one which has been separated from a component of its natural environment. In some embodiments, an antibody is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of antibody purity, see, e.g., Flatman et al., J. Chromatogr. B 848:79-87 (2007).

An "isolated nucleic acid" refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

The term "monoclonal antibody" or "mAb" as used herein refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including but not limited to the hybridoma method, recombinant DNA methods, phage-display methods, and methods utilizing transgenic animals containing all or part of the human immunoglobulin loci, such methods and other exemplary methods for making monoclonal antibodies being described herein.

The term "pharmaceutical formulation" or "pharmaceutical composition" refers to a preparation which is in such form as to permit the biological activity of an active ingredient contained therein, such as the inventive CD3 binding domains and antibodies comprising them, to be effective, and which contains no additional components which are unacceptably toxic to a subject to which the formulation would be administered.

A "pharmaceutically acceptable carrier" refers to an ingredient in a pharmaceutical formulation, other than an active ingredient, which is nontoxic to a subject. A pharmaceutically acceptable carrier includes, but is not limited to, a buffer, excipient, stabilizer, or preservative.

By the phrase "therapeutically effective amount" is meant an amount that produces the desired effect for which it is administered. The exact amount will depend on the purpose of the treatment, and will be ascertainable by one skilled in the art using known techniques (see, for example, Lloyd (1999) The Art, Science and Technology of Pharmaceutical Compounding).

An "immune response" or "immunological response" as used herein, in a subject refers to the development of a humoral immune response, a cellular-immune response, or a humoral and a cellular immune response to an antigen/immunogen. A "humoral immune response" refers to one that is at least in part mediated by antibodies. A "cellular immune response" is one mediated by T-lymphocytes or other white blood cells or both, and includes the production of cytokines, chemokines and similar molecules produced by activated T-cells, white blood cells, or both. Immune responses can be determined using standard immunoassays and neutralization assays, which are known in the art.

"Immunogenicity", as used herein, refers to the capability of a protein or polypeptide to elicit an immune response directed specifically against a bacteria or virus that causes the identified disease.

As used herein, "treatment" (and grammatical variations thereof such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, antibodies of the invention are used to delay development of a disorder or disease or to slow the progression of a disorder or disease.

As used herein, "delaying progression" of a disorder or disease means to defer, hinder, slow, retard, stabilize, and/or postpone development of the disease or disorder (e.g., a cell proliferative disorder, e.g., cancer). This delay can be of varying lengths of time, depending on the history of the disease and/or individual being treated. As is evident to one skilled in the art, a sufficient or significant delay can, in effect, encompass prevention, in that the individual does not develop the disease. For example, a late stage cancer, such as development of metastasis, may be delayed.

By "reduce" or "inhibit" is meant the ability to cause an overall decrease, for example, of 20% or greater, of 50% or greater, or of 75%, 85%, 90%, 95%, or greater. In certain embodiments, reduce or inhibit can refer to the effector function of an antibody that is mediated by the antibody Fc region, such effector functions specifically including complement-dependent cytotoxicity (CDC), antibody-dependent cellular cytotoxicity (ADCC), and antibody-dependent cellular phagocytosis (ADCP).

As used herein, the terms "prevent," "preventing," and "prevention" refer to the prevention or inhibition of the development or onset of a disorder or disease.

As used herein, the terms "ameliorate" and "alleviate" refer to a reduction or diminishment in the severity a condition or any symptoms thereof.

The term "antibody" herein is used in the broadest sense and encompasses various antibody structures, including but not limited to monoclonal antibodies, polyclonal antibodies, multispecific antibodies (e.g., bispecific antibodies), and antibody fragments so long as they exhibit the desired antigen-binding activity. With regard to multispecific antibodies, such antibodies comprise at least two different antigen binding domains which recognized and specifically bind to at least two different antigens. With regard to bispecific antibodies, such antibodies comprise two different antigen binding domains which recognized and specifically bind to at least two different antigens. A "different antigen" or "different antigens" may refer to different and/or distinct proteins, polypeptides, or molecules; as well as different and/or distinct epitopes, which epitopes may be contained within one protein, polypeptide, or other molecule. Unless specifically indicated otherwise, the term "antibody," as used herein, shall also be understood to encompass, in addition to the above, antibody molecules comprising two immunoglobulin heavy chains and two immunoglobulin light chains (i.e., "full antibody molecules") as well as antigen-binding fragments thereof. The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex.

An "antibody" and "antibodies" may also refer to immunoglobulin molecules comprised of four polypeptide chains, two heavy (H) chains and two light (L) chains interconnected by disulfide bonds (i.e., "full antibody molecules"), as well as multimers thereof (e.g. IgM) or antigen-binding fragments thereof. Each heavy chain is comprised of a heavy chain variable region ("VH") and a heavy chain constant region (comprised of domains $C_H1$, $C_H2$ and $C_H3$). Each light chain is comprised of a light chain variable region ("VL") and a light chain constant region ("CL"). The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. In certain embodiments of the invention, the FRs of the antibody (or antigen binding fragment thereof) may be identical to the human germline sequences, or may be naturally or artificially modified. An amino acid consensus sequence may be defined based on a side-by-side analysis of two or more CDRs. Accordingly, the CDRs in a heavy chain are designated "CHRH1", "CDRH2", and "CDRH3", respectively, and the CDRs in a light chain are designated "CDRL1", "CDRL2", and "CDRL3".

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab') 2; diabodies; linear antibodies; single-chain antibody molecules (e.g. scFv); and multispecific antibodies formed from antibody fragments.

By "binding domain" or "antigen binding domain" is meant a part of an antibody, compound, or a molecule that specifically binds to a target epitope, antigen, ligand, or receptor. Binding domains include but are not limited to antibodies (e.g., monoclonal, polyclonal, recombinant, humanized, and chimeric antibodies), antibody fragments or portions thereof (e.g., Fab fragments, Fab'$_2$, scFv antibodies, Fv fragments, SMIP, domain antibodies, diabodies, minibodies, scFv-Fc, affibodies, nanobodies, and VH and/or VL domains of antibodies), receptors, ligands, aptamers, and other molecules having an identified binding partner.

An "affinity matured antibody" refers to an antibody with one or more alterations in one or more complementary determining regions (CDRs), compared to a parent antibody which does not possess such alterations, such alterations resulting in an improvement in the affinity of the antibody for antigen. Substitution of one or more CDR residues or omission of one or more CDRs is also possible. Antibodies have been described in the scientific literature in which one or two CDRs can be dispensed with for binding. Padlan et al. (1995 FASEB J. 9:133-139) analyzed the contact regions between antibodies and their antigens, based on published crystal structures, and concluded that only about one fifth to one third of CDR residues actually contact the antigen. Padlan also found many antibodies in which one or two CDRs had no amino acids in contact with an antigen (see also, Vajdos et al. 2002 J Mol Biol 320:415-428). CDR residues not contacting antigen can be identified based on previous studies (for example residues H60-H65 in CDRH2 are often not required), from regions of Kabat CDRs lying outside Chothia CDRs, by molecular modeling and/or empirically. If a CDR or residue(s) thereof is omitted, it is usually substituted with an amino acid occupying the corresponding position in another human antibody sequence or a consensus of such sequences. Positions for substitution within CDRs and amino acids to substitute can also be selected empirically.

Fully human monoclonal antibodies as disclosed herein may comprise one or more amino acid substitutions, insertions and/or deletions in the framework and/or CDR regions of the heavy and light chain variable domains as compared to the corresponding germline sequences. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding affinity, improved or enhanced antagonistic or agonistic biological properties (as the case may be), reduced immunogenicity, etc. Antibodies and antigen-binding fragments obtained in this general manner are encompassed within the present invention.

The present invention also includes fully monoclonal antibodies comprising variants of any of the CDR amino acid sequences disclosed herein having one or more conservative substitutions. For example, the present invention includes antibodies having CDR amino acid sequences with, e.g., 10 or fewer, 8 or fewer, 6 or fewer, 4 or fewer, etc. conservative amino acid substitutions relative to any of the CDR amino acid sequences disclosed herein.

The terms "anti-CD3 antibody", "anti-CD3 binding domain-comprising antibody", "an antibody that binds to CD3", "a CD3 binding domain", "an antibody comprising a CD3 binding domain", and the like refer to an antibody (or a CD3 binding domain) that is capable of binding CD3 with sufficient affinity and/or specificity such that the antibody is useful as a diagnostic and/or therapeutic agent in targeting CD3. In one embodiment, the extent of binding of an anti-CD3 antibody to an unrelated, non-CD3 protein is less than about 10% of the binding of the antibody to CD3 as measured, e.g., by one of a variety of solution and surface based affinity measurement methodologies and instrumentation, such as, e.g., biolayer interferometry (BLI), surface plasmon resonance (SPR), solution equilibrium based kinetic exclusion assays, KinExA direct association, assays using FORTEBIO instruments and reagents, such as Octet RED 384 and HTX BLI-based instruments, enzyme-linked immunosorbent assays (ELISA), and radioimmunoassay (RIA) (see, e.g., Estep et al, *MAbs*, Vol. 5, pages 270-278 (2013); Yu et al., *J Biomol Screen*, Vol. 21, pages 88-95 (2016)). In certain embodiments, an antibody that binds to CD3 has a dissociation constant (Kd) of <1 mM, <100 nM, <10 nM, <1 nM, <0.1 nM, <0.01 nM, or <0.001 nM (e.g. $10^{-8}$ M or less, e.g. from $10^{-8}$ M to $10^{-13}$ M, e.g., from $10^{-9}$ M to $10^{-13}$ M). In certain embodiments, an anti-CD3 antibody binds to an epitope of CD3 that is conserved among CD3 from different species.

The term "developable" refers to extent to which one or more polypeptides in a plurality of polypeptides possess desirable characteristics, such as, e.g.: desirable expression, for example, in mammalian cells; solubility; viscosity; aggregation; chemical and/or physical stability; desirable "shelf-life"; melting temperature; pharmacokinetic profiles; circulation half-life; and clearance characteristics. Such characteristics may serve as indicia, independently, as combinations of sub-sets of such indicia, or in totality, for the likelihood that such one or more polypeptides may be successfully developed as a therapeutic candidate, and ultimately an approved drug. Accordingly, as understood in the art, generally, polypeptides with desirable developability characteristics possess, e.g., relatively high solubility, relatively low viscosity, relatively low propensity for aggregation, relatively high chemical stability, relatively high physical stability, relatively long "shelf life", relatively high melting temperature, relatively long circulation half-life, relatively long clearance time, and the like. Polypeptides with undesirable developability characteristics possess, e.g., relatively low solubility, relatively high viscosity, relatively high propensity for aggregation, relatively poor chemical stability, relatively poor physical stability, relatively short "shelf life", relatively low melting temperature, relatively short circulation half-life, relatively short clearance time, and the like.

Methods and assays which may be employed to ascertain the degree to which polypeptides, such as the inventive CD3 binding domains and antibodies comprising them, possess such desirable (or undesirable, as the case may be) developability characteristics are available in the art, and include, for example; those disclosed in WO 2014/179363 and Xu et al., *Protein Eng Des Sol*, Vol. 26, pages 663-670 (2013); SMP and SCP assays and the like cross interaction chromatography (CIC); self-interaction chromatography (SIC); dynamic light scattering; size exclusion chromatography (SEC), dynamic light scattering (DLS) spectroscopy; photon correlation spectroscopy; quasi-elastic light scattering, circular dichroism (CD), viscosity measurements; whole cell binding; tissue micro array methodologies; BVP ELISA assays; AC-SINS assays (Liu et al; MAbs, Vol. 6, pages 483-492 (2014); differential scanning calorimetry; and the like (see, e.g., He et al., *J. Pharm. Sci.*, Vol. 100(4), pp. 1330-1340 (2011); Wagner et al., *Pharm. Develop. & Technol* (posted online 2012; hyper-text transfer protocol: informahealthcare.com/doi/abs/10.3109/10837450.2011.649851); Hotzel et al., *mAbs*, Vol. 4(6), pages 753-7601 (2012); Weiqiang et al., *J. Pharm. Sci.*, Vol. 101(5), pp. 1701-1720 (2012); Banks et al., *J. Pharm. Sci.*, Vol. 101(8), pp. 2720-2732 (2012); Lie et al., *J. Pharm. Sci.*, Vol. 94(9), pp. 1928-1948 (2005); and Payne et al., *Biopolymers*, Vol. 85(5), pp. 527-533 (2006)).

Furthermore polypeptides, such as the inventive CD3 binding domains and antibodies comprising them selected or identified as possessing enhanced developability are referred to as "developable". Polypeptides that are detected in accordance with the disclosed and claimed methods as possessing decreased developability are so detected by virtue of their interaction with the disclosed and claimed PSRs, and as such are referred to as "polyspecific" polypeptides. Such polyspecific polypeptides are further referred to as relatively "undevelopable" or relatively "non-developable" polypeptides.

Any means for detecting an interaction between one or more polypeptides and a moiety with which the one or more polypeptide interacts may be employed in accordance with the disclosed and claimed methods. Exemplary such means include, e.g.: flow cytometry; magnetic-activated cell sorting (MAGS); fluorescence assisted cell sorting (FACS); immunohistochemistry; column and/or affinity chromatography or separations; sedimentation methodologies (e.g., centrifugation); immunoprecipitation; two-hybrid assays, such as mammalian two-hybrid assays and yeast two-hybrid assays; fluorescence resonance energy transfer (FRET) assays; affinity chromatography; and the like. In certain embodiments detecting such an interaction comprises employing magnetic-activated cell sorting (MAGS); fluorescence assisted cell sorting (FACS); and/or combinations of magnetic-activated cell sorting (MAGS) and fluorescence assisted cell sorting (FACS).

A "developability score" also known as a "developability profile", refers to an index that may be assigned to the inventive CD3 binding domains and/or antibodies comprising them upon assessing developability as described herein and in, e.g., WO 2014/179363 and Xu et al., *Protein Eng Des Sol*, Vol. 26, pages 663-670 (2013). The developability score is thus a measure or metric by which developability of CD3 binders and/or antibodies comprising them may be assessed, compared, and/or ranked. Such developability scores serve as a measure of the degree of interaction of CD3 binders and antibodies comprising them. The degree of interaction may be assessed by any number of means available in the art that provides an output value that correlates with a strength or affinity of a polypeptide for a moiety to which it is bound. Exemplary such means include flow cytometry means, such as FACS; ELISA; quantitative immunoaffinity assays or immunoprecipitation assays; mammalian two-hybrid or yeast two-hybrid assays, and the like. In the context of FACS, as demonstrated in the Examples, a degree of interaction between polypeptides in the plurality and the PSR may be ascertained by generating a mean fluorescence intensity (MFI) for each polypeptide- PSR interaction that is detected, and then ordering the MFI in either ascending or descending order, thereby ranking the polypeptides in the plurality according to the relative degree of interaction between each detected polypeptide and the PSR. Such a ranking provides for a ranking of polypeptides of the plurality such that those polypeptides possessing enhanced developability are readily ascertained, as are those polypeptides possessing decreased developability. In certain embodiments, an MFI of 500 or less is demonstrative of a polypeptide possessing enhanced developability. In certain embodiments, an MFI of 400 or less is demonstrative of a polypeptide possessing enhanced developability. In certain embodiments, an MFI of 300 or less is demonstrative of a polypeptide possessing enhanced developability. In certain embodiments, an MFI of 200 or less is demonstrative of a polypeptide possessing enhanced developability. In certain embodiments, an MFI of 100 or less is demonstrative of a polypeptide possessing enhanced developability. In certain embodiments, an MFI of 1000 or more is demonstrative of polypeptide possessing decreased developability. In certain embodiments, an MFI of 900 or more is demonstrative of polypeptide possessing decreased developability. In certain embodiments, an MFI of 800 or more is demonstrative of polypeptide possessing decreased developability. In certain embodiments, an MFI of 700 or more is demonstrative of polypeptide possessing decreased developability. In certain embodiments, an MFI of 600 or less is demonstrative of a polypeptide possessing decreased developability.

A developability score may also take the form of a normalized score, for example, on a scale of 0.0 to 1.0, in which the score of one or more test CD3 binders and/or antibodies comprising them are normalized to the developability score determined by performing the assay with a standard, or control, polypeptide or antibody. An exemplary such standard or control antibody may comprise, e.g., a hen egg lysozyme-binding (HEL) antibody, such as ADI-03847.

The terms "cytokine release syndrome", "cytokine release crisis", or "cytokine storm" refers to a pro-inflammatory, positive feedback loop between cytokines and immune cells leading to excessive or uncontrolled release of pro-inflammatory cytokines by cells within immune system (e.g., T cells) (see, e.g., Lee et al., Blood, Vol. 124, pages 188-195 (2014) and Tisoncik et al., Microbiol Mol Biol Rev, Vol. 76, pages 16-32 (2012). Without wishing to be bound by any theory, it is believed that upon stimulation and activation, the immune cells (e.g., T cells) release a series of cytokines to a level and degree that generates untoward biological/physiological effects or varying degree and severity, including acute inflammation characterized by, e.g., rubor (redness), swelling or edema, calor (heat), dolor (pain), and "functio laesa" (loss of function); when localized in skin or other tissue: increase blood flow, enabling vascular leukocytes and plasma proteins to reach extravascular sites of injury, increasing local temperatures and generation of pain, tissue edema and extravascular pressure and a reduction in tissue perfusion; organ and system dysfunction, such as cardiac dysfunction, adult respiratory distress syndrome, neurologic toxicity, renal and/or hepatic failure, and disseminated intravascular coagulation. Although numerous cytokines appear to associate with onset of CRS, elevated levels of IFNγ, IL-6, TNFα, TGFbeta, IL-2, granulocyte macrophage-colony-stimulating factor (GM-CSF), IL-10, IL-8, L-5, and/or fractalkine are implicated as predictive and/or causative of CRS or the propensity to elicit CRS upon T-cell stimulation. In certain embodiments of the invention, elevated levels of Interleukin 6 (IL-6); Interleukin 12 (IL-12); tumor necrosis factor alpha (TNFa); (TGFb); Interleukin-2 (IL-2); and/or interferon gamma (IFNg) production by T-cells incubated with the CD3 binding domains and antibodies comprising them are predictive of the propensity to elicit CRS. In certain embodiments of the invention, elevated levels interferon gamma (IFNg) production by T-cells incubated with the CD3 binding domains and antibodies comprising them are predictive of the propensity to elicit CRS.

A "cytokine release syndrome risk score", also known as a "cytokine release syndrome risk profile", "CRS risk score", or "CRS risk profile", refers to an index that may be assigned to the inventive CD3 binding domains and/or antibodies comprising them upon assessing the propensity to elicit cytokine production levels from T cells incubated or contacted with the inventive CD3 binding domains (and/or antibodies comprising them) to levels that would be predicted or expected, and/or in fact demonstrated, to be sufficient to induce cytokine release syndrome in subjects. The developability score is thus a measure or metric by which CRS risk of CD3 binders and/or antibodies comprising them may be assessed, compared, and/or ranked. Such CRS risk scores serve as a measure of the propensity, either predictive or demonstrative, of CD3 binders and antibodies comprising them to elicit cytokine release when assessed in either an in vitro (e.g., cell-based) or an in vivo (e.g., in a test subject or patient) cytokine release assay. Such assays are available to the artisan and include, in certain embodiments of the invention e.g., the use of PBMCs, either as cultured cell lines or as primary cells obtained from living donors, to assess the ability of immunomodulatory agents, such as CD3 binding domains and antibodies comprising them, to induce cytokine production/secretion in cell-based cytokine release assays performed in immobilized or, preferably soluble antibody formats (see, e.g., Vessillier et al., J Immunol Methods, Vol. 424, pages 43-52 (2015). Generally, production levels of cytokines that are measured as indicators or predictive of CRS risk, as understood by the artisan and/or as disclosed therein and throughout, that are lower for test molecules than that determined for known (i.e., "positive control") inducers of cytokine release syndrome or cytokine storm are indicative of diminished risk of inducing CRS by the test inducers.

The term "recombinant" generally refers to any protein, polypeptide, or cell expressing a gene of interest that is produced by genetic engineering methods. The term "recombinant" as used with respect to a protein or polypeptide, means a polypeptide produced by expression of a recombinant polynucleotide. The proteins used in the immunogenic compositions of the invention may be isolated from a natural source or produced by genetic engineering methods.

The antibodies of the invention may, in some embodiments, be recombinant human antibodies. The term "recombinant human antibody", as used herein, is intended to include all antibodies, including human or humanized antibodies, that are prepared, expressed, created or isolated by recombinant means, such as antibodies expressed using a recombinant expression vector transfected into a host cell (described further below), antibodies isolated from a recombinant, combinatorial human antibody library (described further below), antibodies isolated from an animal (e.g., a mouse) that is transgenic for human immunoglobulin genes (see e.g., Taylor et al. (1992) Nucl. Acids Res. 20:6287-6295) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

The term "specifically binds," or "binds specifically to", or the like, means that an antibody or antigen-binding fragment thereof forms a complex with an antigen that is relatively stable under physiologic conditions. Specific binding can be characterized by an equilibrium dissociation constant of at least about $1\times10^{-6}$ M or less (e.g., a smaller $K_D$ denotes a tighter binding). Methods for determining whether two molecules specifically bind are well known in the art and include, for example, equilibrium dialysis, surface plasmon resonance, and the like. As described herein, antibodies have been identified by surface plasmon resonance, e.g., BIACORE™, biolayer interferometry measurements using, e.g., a FORTEBIO Octet HTX instrument (Pall Life Sciences), which bind specifically to CD3. Moreover, multi-specific antibodies that bind to CD3 and one or more additional antigens, or a bi-specific that binds to two different regions of CD3 and/or different regions of an additional antigen are nonetheless considered antibodies that "specifically bind", as used herein. In certain embodiments, the antibodies disclosed herein display equilibrium dissociation constants (and hence specificities) of about $1\times10^{-6}$ M; about $1\times10^{-7}$ M; about $1\times10^{-8}$ M; about $1\times10^{-9}$ M; about $1\times10^{-10}$ M; between about $1\times10^{-6}$ M and about $1\times10^{-7}$ M; between about $1\times10^{-7}$ M and about $1\times10^{-8}$ M; between about $1\times10^{-8}$ M and about $1\times10^{-9}$ M; or between about $1\times10^{-9}$ M and about $1\times10^{-10}$ M.

The term "high affinity" antibody refers to those mAbs having a binding affinity to CD3, expressed as $K_D$, of at least $10^{-9}$ M; more preferably $10^{-10}$ M, more preferably $10^{-11}$ M, more preferably $10^{-12}$ M as measured by surface plasmon resonance, e.g., BIACOR, biolayer interferometry measurements using, e.g., a FORTEBIO Octet HTX instrument (Pall Life Sciences), or solution-affinity ELISA.

By the term "slow off rate", is meant an antibody that dissociates from CD3, with a rate constant ($K_{off}$ or $K_D$) of $1\times10^{-3}$ s$^{-1}$ or less, preferably $1\times10^{-4}$ s$^{-1}$ or less, as determined by surface plasmon resonance, e.g., BIACORE™ or a FORTEBIO Octet HTX instrument (Pall Life Sciences).

Further with regard to antibody fragments such antibody fragments may include a Fab fragment, a F(ab')$_2$ fragment, a Fv fragment, a dAb fragment, a fragment containing a CDR, or an isolated CDR. Antigen-binding fragments of an antibody may be derived, e.g., from full antibody molecules using any suitable standard techniques such as proteolytic digestion or recombinant genetic engineering techniques involving the manipulation and expression of DNA encoding antibody variable and (optionally) constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')$_2$ fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g., monovalent nanobodies, bivalent nanobodies, etc.), small modular immunopharmaceuticals (SMIPs), and shark variable IgNAR domains, are also encompassed within the expression "antigen-binding fragment," as used herein.

An antigen-binding fragment of an antibody will typically comprise at least one variable domain. The variable domain may be of any size or amino acid composition and will generally comprise at least one CDR, which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_h1$-$C_h2$; (V) $V_H$-$C_h1$-$C_h2$-$C_H3$; (vi) $V_H$-$C_H2$-$C_H3$; (vii) $V_H$-$C_L$; (viii) $V_L$-$C_H1$; (ix) $V_L$-$C_H2$; (x) $V_L$-$C_H3$; (xi) $V_L$-$C_H1$-$C_H2$; (xii) $V_L$-$C_H1$-$C_H2$-$C_H3$; (xiii) $V_L$-$C_H2$-$C_H3$; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids, which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be mono-specific or multi-specific (e.g., bi-specific). A multi-specific antigen-binding fragment of an antibody will typically comprise at least two different variable domains, wherein each variable domain is capable of specifically binding to a separate antigen or to a different epitope on the same antigen. Any multi-specific antibody format, including the exemplary bi-specific antibody formats disclosed herein, may be adapted for use in the context of an antigen-binding fragment of an antibody of the present invention using routine techniques available in the art. Non-limiting examples of multispecific and bispecific formats that re amenable to incorporation of the inventive anti-CD3 binding domains include, e.g., Fab-Fc-scFv ("bottle-opener") (XENCOR), Mab-scFv (XENCOR), Mab-Fv (XENCOR), Dual scFv (XENCOR), central Fv (XENCOR), central scFv(XENCOR), one-arm central scFv (XE- NCOR), Fab-Fab (XENCOR), Fab-Fv (XENCOR), mAb-Fv (XENCOR), mAb-Fab (XENCOR), DART (MACROGENICS), BiTE (AMGEN/MICROMET), KiTE, common light chain-IgG (Genentech), TandAb (SFFIMED) Cross-Mab (ROCHE), SEED (EMD SERONO), BEAT (GLENMARK), TrioMab (TRION PHARMA/FRESENIUS BIOTECH), DuetMab (MEDIMMUNE), and others, as disclosed, e.g., in (WO 95/09917; WO 2008/119566; WO 2008/119567; WO2011/121110; WO 2010/037835; WO 2007/042261; WO 2007/110205; WO 2011/121110; WO 2012/055961; WO 2012/16067; WO 2016/086189; WO 2016/182751; WO 2015/006749; WO 2014/049003; WO 2013/177101; WO 2015/128509; U.S. Pat. No. 7,951,917; US 2009/0252729; US 2014/0348839; U.S. Pat. No. 7,183,076; Mazor et al., *Mabs*, Vol. 7, pages 377-389 (2015); Muda et al., *Protein Engineering, Designe, & Selection*, Vol. 24, pages 447-454 (2011); and Del Bano et al., *Antibodies*, Vol. 5, pages 1-23 (2016).

The specific embodiments, antibody or antibody fragments of the invention may be conjugated to a therapeutic moiety ("immunoconjugate"), such as an antibiotic, a second anti-CD3 antibody, a vaccine, or a toxoid, or any other useful therapeutic moiety.

An "isolated antibody", as used herein, is intended to refer to an antibody that is substantially free of other antibodies (Abs) having different antigenic specificities (e.g., an isolated antibody that specifically binds CD3, or a fragment thereof, is substantially free of Abs that specifically bind antigens other than CD3.

A "blocking antibody" or a "neutralizing antibody", as used herein (or an "antibody that neutralizes CD3 activity"), is intended to refer to an antibody whose binding to CD3, as the case may be as disclosed herein, results in inhibition of at least one biological activity of CD3.

The term "surface plasmon resonance", as used herein, refers to an optical phenomenon that allows for the analysis of real-time biomolecular interactions by detection of alterations in protein concentrations within a biosensor matrix, for example using the BIACORE™ system (Pharmacia Biosensor AB, Uppsala, Sweden and Piscataway, N.J.).

The term "$K_D$", as used herein, is intended to refer to the equilibrium dissociation constant of a particular antibody-antigen interaction.

The term "epitope" refers to an antigenic determinant that interacts with a specific antigen binding site in the variable region of an antibody molecule known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

The term "substantial identity", or "substantially identical," when referring to a nucleic acid or fragment thereof, or an amino acid sequence or a fragment thereof, indicates that, when optimally aligned with appropriate insertions or deletions with another nucleic acid sequence or amino acid sequence, as the case may be, (or its complementary strand), there is sequence identity in at least about 100%, at least about 99%, at least about 98%, at least about 97%, at least about 96%, at least about 95%, at least about 94%, at least about 93%, at least about 92%, at least about 91%, at least about 90%, at least about 89%, at least about 88%, at least about 87%, at least about 86%, at about 85%, at least about 84%, at least about 83%, at least about 82%, at least about 80%, and optionally so on, as measured by any well-known algorithm of sequence identity, such as FASTA, BLAST or GAP, as discussed below. Accordingly, sequences that display a certain percentage "identity" share that percentage identity, and/or are that percentage "identical" to one another.

In certain embodiments, the disclosed CD3 binding domains, and/or the individual heavy chain (HC) sequence, light chain (LC) sequence, CDRH3 sequence, CDRH2 sequence, CHRH1 sequence, CDRL3 sequence, CDRL2 sequence, CDRL1 sequence, and/or framework sequences are independently at least about 100%, at least about 99%, at least about 98%, at least about 97%, at least about 96%, at least about 95%, at least about 94%, at least about 93%, at least about 92%, at least about 91%, at least about 90%, at least about 89%, at least about 88%, at least about 87%, at least about 86%, at about 85%, at least about 84%, at least about 83%, at least about 82%, at least about 80%; and/or all percentages of identity in between; to other sequences and/or share such percentage identities with one another (or with certain subsets of the herein-disclosed antibody sequences).

In certain embodiments, the disclosed antibody amino acid sequences are, e.g.; at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to other sequences and/or share such percentage identities with one another (or with certain subsets of the herein-disclosed antibody sequences).

Preferably, residue positions, which are not identical, differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent or degree of similarity may be adjusted upwards to correct for the conservative nature of the substitution. Means for making this adjustment are well known to those of skill in the art. (See, e.g., Pearson (1994) Methods Mol. Biol. 24: 307-331). Examples of groups of amino acids that have side chains with similar chemical properties include 1) aliphatic side chains: glycine, alanine, valine, leucine and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45. A "moderately conservative" replacement is any change having a nonnegative value in the PAM250 log-likelihood matrix.

Sequence similarity for polypeptides is typically measured using sequence analysis software. Protein analysis software matches similar sequences using measures of similarity assigned to various substitutions, deletions and other modifications, including conservative amino acid substitutions. For instance, GCG software contains programs such as GAP and BESTFIT which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA with default or recommended parameters; a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. (See, e.g., Altschul et al. (1990) J. Mol. Biol. 215: 403 410 and (1997) Nucleic Acids Res. 25:3389 402).

In certain embodiments, the antibody or antibody fragment for use in the method of the invention may be monospecific, bi-specific, or multi-specific. Multi-specific antibodies may be specific for different epitopes of one target polypeptide or may contain antigen-binding domains specific for epitopes of more than one target polypeptide. An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise an Y96F modification (by IMGT; Y436F by EU). Further modifications that may be found within the second $C_H3$ include: D16E, L18M, N44S, K52N, V57M, and V82I (by IMGT; D356E, L358M, N384S, K392N, V397M, and V422I by EU) in the case of IgG1 mAbs; N44S, K52N, and V82I (IMGT; N384S, K392N, and V422I by EU) in the case of IgG2 mAbs; and Q15R, N44S, K52N, V57M, R69K, E79Q, and V82I (by IMGT; Q355R, N384S, K392N, V397M, R409K, E419Q, and V422I by EU) in the case of IgG4 mAbs. Variations on the bi-specific antibody format described above are contemplated within the scope of the present invention.

Exemplary Anti-CD3 Binding Domains and Antibodies Comprising them

As mentioned above, in certain embodiments of the invention a large series of CD3 binding domains and antibodies comprising them, and methods of preparing and using them are provided. Surprisingly, species of this large series of CD3 binding domains collectively display desirable properties, including, e.g., a broad range of affinities for CD3 epsilon; cross-reactivity towards both human CD3 ("Hu CD3") and cynomolgus CD3 ("Cy CD3"); as well as desirable developability profiles and/or cytokine release syndrome (CRS) risk profiles. In certain embodiments, the inventive CD3 binding domains, and antibodies comprising them, display developability profiles and/or CRS risk profiles that are superior to the developability profiles and/or CRS risk profiles of other anti-CD3 antibodies. In certain embodiments, the inventive CD3 binding domains, and antibodies comprising them, display developability profiles and/or CRS risk profiles that are superior to the developability profiles and/or CRS risk profiles of, e.g., 12C; SP34; 38E4; CAB21609_A01, CAB21609_B01, CAB21609_C01, and/or CAB21609_D01 as disclosed herein as well as in Yang et al., J Immunol, Vol 137, pages 1097-1100 (Aug. 4, 1986); US 2014/008295; and WO 2015/095392.

In certain embodiments, the invention provides CD3 binding domains and antibodies comprising them that bind to CD3 (e.g., CD3ε and/or CD3γ).

In certain embodiments, the inventive CD3 binding domains and antibodies comprising them are provided which display an enhanced developability profile relative to other CD3 binding domains (or antibodies comprising them). In certain embodiments, the inventive CD3 binding domains and antibodies comprising them are provided which display an enhanced developability profile relative to one or more of: trastuzumab; (Herceptin®); lintuzumab; blinatumomab (Blincyto®); and Mab 364, Mab 366, Mab 367, Mab 368, Mab 369, Mab 370, or Mab 22, as provided in Table 2.

In certain embodiments, the inventive CD3 binding domains and antibodies comprising them display a developability score of: between about 0 MFI and about 500 MFI; between about 0 MFI and about 450 MFI; between about 0 MFI and about 400 MFI; between about 0 MFI and about 350 MFI; between about 0 MFI and about 300 MFI; between about 0 MFI and about 250 MFI; between about 0 MFI and about 200 MFI; between about 0 MFI and about 150 MFI; between about 0 MFI and about 100 MFI; between about 0 MFI and about 50 MFI; between about 200 MFI and 500 MFI; between about 200 MFI and about 450 MFI; between about 200 MFI and about 400 MFI; between about 200 MFI and about 350 MFI; between about 200 MFI and about 300 MFI; between about 200 MFI and about 250 MFI; between about 100 MFI and about 450 MFI; between about 100 MFI and about 400 MFI; between about 100 MFI and about 350 MFI; between about 100 MFI and about 300 MFI; between about 100 MFI and about 250 MFI; between about 100 MFI and about 200 MFI; or between about 100 MFI and about 150 MFI.

In other embodiments, the inventive CD3 binders and antibodies comprising them display a normalized developability score of between about 0.0 and about 0.6; between about 0.0 and about 0.57; between about 0.0 and about 0.55; between about 0.0 and about 0.53; between about 0.0 and about 0.51; between about 0.0 and about 0.49; between about 0.0 and about 0.47; between about 0.0 and about 0.45; between about 0.0 and about 0.43; between about 0.0 and about 0.41; between about 0.0 and about 0.39; between about 0.0 and about 0.37; between about 0.0 and about 0.35; between about 0.0 and about 0.33; between about 0.0 and about 0.31; between about 0.0 and about 0.29; between about 0.0 and about 0.27; between about 0.0 and about 0.25; between about 0.0 and about 0.23; between about 0.0 and about 0.21; between about 0.0 and about 0.19; between about 0.0 and about 0.17; between about 0.0 and about 0.15; between about 0.0 and about 0.13; between about 0.0 and about 0.11; between about 0.0 and about 0.09; between about 0.0 and about 0.07; or between about 0.0 and about 0.05.

In certain embodiments, the developability profile and/or developability score for the inventive CD3 binders and antibodies comprising them is obtained by performing a PSR assay; an SCP assay; AS-CINS; a BVP assay; an ELISA; a DSF assay; a Tm assay; a HIC assay; a CIC assay; or combinations thereof.

In other embodiments, the inventive CD3 binding domains and antibodies comprising them elicit potent T cell activation or T cell killing while displaying a decreased propensity to elicit cytokine production to levels capable of inducing cytokine release syndrome. In certain embodiments, at least one cytokine for which cytokine production levels are measured in order to assess the propensity to elicit cytokine production levels capable of inducing cytokine release syndrome is selected from the group consisting of: Interleukin 6 (IL-6); Interleukin 12 (IL-12); tumor necrosis factor alpha (TNFa); (TGFb); Interleukin-2 (IL-2); and Interferon gamma (IFNg).

In certain embodiments, the inventive CD3 binding domains and antibodies comprising them elicit T cell activation or T cell killing while displaying a decreased propensity to elicit cytokine production to levels capable of inducing cytokine release relative to that observed one or more of: trastuzumab; (Herceptin®); lintuzumab; blinatumomab (Blincyto®); and Mab 364, Mab366, Mab 367, Mab 368, Mab 369, Mab 370, or Mab 22, as provided in Table 2. In certain embodiments, at least one cytokine for which cytokine production levels are measured in order to assess the propensity to elicit cytokine production levels capable of inducing cytokine release syndrome is selected from the group consisting of: Interleukin 6 (IL-6); Interleukin 12 (IL-12); tumor necrosis factor alpha (TNFa); (TGFb); Interleukin-2 (IL-2); and Interferon gamma (IFNg).

In certain embodiments, the inventive CD3 binding domains and antibodies comprising them display a cytokine release syndrome risk profile that is indicative of decreased risk of eliciting cytokine release syndrome (CRS). In other embodiments, the inventive CD3 binding domains and antibodies comprising them display a cytokine release syndrome risk profile that is indicative of decreased risk of eliciting cytokine release syndrome (CRS) when compared to the cytokine release syndrome risk profile assessed for one or more of: trastuzumab; (Herceptin®); lintuzumab; blinatumomab (Blincyto®); and Mab 364, Mab366, Mab 367, Mab 368, Mab 369, Mab 370, or Mab 22, as provided in Table 2.

In certain embodiments, the invention provides an antibody comprising a CDRH3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH3 selected from the group consisting of the CDRH3s of Mabs 1 through 21, 23 through 222, 224 through 363, and 371 through 405 as provided in Table 2; with the proviso that the CDRH3 is not 100% identical to the CDRH3 of any of Mabs 223, 364, 365, 366, 367, 368, 369, or 370 as provided in Table 2.

In certain embodiments, the invention provides an antibody comprising a CDRH2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH2 selected from the group consisting of the CDRH2s of Mabs 1 through 21, 23 through 222, 224 through 363, and 371 through 405 as provided in Table 2; with the proviso that the CDRH2 is not 100% identical to the CDRH2 of any of Mabs 223, 364, 365, 366, 367, 368, 369, or 370 as provided in Table 2.

In certain embodiments, the invention provides an antibody comprising a CDRH1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH1 selected from the group consisting of the CDRH1s of Mabs 1 through 21, 23 through 222, 224 through 363, and 371 through 405 as provided in Table 2; with the proviso that the CDRH1 is not 100% identical to the CDRH1 of any of Mabs 223, 364, 365, 366, 367, 368, 369, or 370 as provided in Table 2.

In certain embodiments, the invention provides an antibody comprising a CDRL3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL3 selected from the group consisting of the CDRL3s of Mabs 1 through 21, 23 through 222, 224 through 363, and 371 through 405 as provided in Table 2; with the proviso that the CDRL3 is not 100% identical to the CDRL3 of any of Mabs 223, 364, 365, 366, 367, 368, 369, or 370 as provided in Table 2.

In certain embodiments, the invention provides an antibody comprising a CDRL2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL2 selected from the group consisting of the CDRL2s of Mabs 1 through 21, 23 through 222, 224 through 363, and 371 through 405 as provided in Table 2; with the proviso that the CDRL2 is not 100% identical to the CDRL2 of any of Mabs 223, 364, 365, 366, 367, 368, 369, or 370 as provided in Table 2.

In certain embodiments, the invention provides an antibody comprising a CDRL1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL1 selected from the group consisting of the CDRL1s of Mabs 1 through 21, 23 through 222, 224 through 363, and 371 through 405 as provided in Table 2; with the proviso that the CDRL1 is not 100% identical to the CDRL1 of any of Mabs 223, 364, 365, 366, 367, 368, 369, or 370 as provided in Table 2.

In certain embodiments, the invention provides an antibody comprising a heavy chain (HC) variable region that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; an HC variable region selected from the group consisting of the HC variable regions of Mabs 1 through 21, 23 through 222, 224 through 363, and 371 through 405 as provided in Table 2; with the proviso that the HC variable region is not 100% identical to the HC variable region of any of Mabs 223, 364, 365, 366, 367, 368, 369, or 370 as provided in Table 2.

In certain embodiments, the invention provides an antibody comprising a light chain (LC) variable region that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a LC variable region selected from the group consisting of the LC variable regions of Mabs 1 through 21, 23 through 222, 224 through 363, and 371 through 405 as provided in Table 2; with the proviso that the LC variable region is not 100% identical to the LC variable region of any of Mabs 223, 364, 365, 366, 367, 368, 369, or 370 as provided in Table 2.

In certain embodiments, the invention provides an antibody comprising a CDRH3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH3 selected from the group consisting of the CDRH3s of Mabs 1 through 21, 23 through 222, 224 through 363, and 371 through 405 as provided in Table 2; a CDRH2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH2 selected from the group consisting of the CDRH2s of Mabs 1 through 21, 23 through 222, 224 through 363, and 371 through 405 as provided in Table 2; and a CDRH1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH1 selected from the group consisting of the CDRH1s of Mabs 1 through 21, 23 through 222, 224 through 363, and 371 through 405 as provided in Table 2; with the proviso that the neither the CDRH3, CDRH2, nor the CHRH1 is 100% identical to the CHRH3, CDRH2, or CDRH1, respectively, of any of Mabs 223, 364, 365, 366, 367, 368, 369, or 370 as provided in Table 2.

In certain embodiments, the invention provides an antibody comprising a CDRL3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL3 selected from the group consisting of the CDRL3s of Mabs 1 through 21, 23 through 222, 224 through 363, and 371 through 405 as provided in Table 2; a CDRL2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL2 selected from the group consisting of the CDRL2s of Mabs 1 through 21, 23 through 222, 224 through 363, and 371 through 405 as provided in Table 2; and a CDRL1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical; to a CDRL1 selected from the group consisting of the CDRL1s of Mabs 1 through 21, 23 through 222, 224 through 363, and 371 through 405 as provided in Table 2; with the proviso that the neither the CDRL3, CDRL2, nor the CHRL1 is 100% identical to the CHRL3, CDRL2, or CDRL1, respectively, of any of Mabs 223, 364, 365, 366, 367, 368, 369, or 370 as provided in Table 2.

In certain embodiments, the invention provides an antibody comprising a CDRH3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH3 selected from the group consisting of the CDRH3s of Mabs 1 through 21, 23 through 222, 224 through 363, and 371 through 405 as provided in Table 2; a CDRH2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH2 selected from the group consisting of the CDRH2s of Mabs 1 through 21, 23 through 222, 224 through 363, and 371 through 405 as provided in Table 2; a CDRH1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH1 selected from the group consisting of the CDRH1s of Mabs 1 through 21, 23 through 222, 224 through 363, and 371 through 405 as provided in Table 2; a CDRL3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL3 selected from the group consisting of the CDRL3s of Mabs 1 through 21, 23 through 222, 224 through 363, and 371 through 405 as provided in Table 2; a CDRL2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL2 selected from the group consisting of the CDRL2s of Mabs 1 through 21, 23 through 222, 224 through 363, and 371 through 405 as provided in Table 2; and a CDRL1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL1 selected from the group consisting of the CDRL1s of Mabs 1 through 21, 23 through 222, 224 through 363, and 371 through 405 as provided in Table 2; with the proviso that the neither the CDRH3, CDRH2, CDRH1, CDRL3, CDHL2, nor the CHRL1 is 100% identical to the CHRH3, CDRH2, CDRH1, CDRL3, CDHL2, or the CDRL1, respectively, of any of Mabs 223, 364, 365, 366, 367, 368, 369, or 370 as provided in Table 2.

In certain embodiments, the invention provides an antibody comprising a CD3 binding domain selected from the group consisting of: the CD3 binding domains of ADI-15512; ADI-15516; and ADI-16513; as provided in Table 2.

In certain embodiments, the invention provides an antibody comprising a CD3 binding domain selected from the group consisting of: the CD3 binding domains of ADI-18562; ADI-18564; ADI-18565; ADI-18566; ADI-18567; ADI-18568; ADI-18570; ADI-18571; ADI-18572; ADI-18573; ADI-18563; ADI-18569; ADI-18574; ADI-18575; ADI-18576; ADI-18578; ADI-18579; ADI-18580; ADI-18581; ADI-18582; ADI-18584; ADI-18585; ADI-18577; ADI-18583; ADI-18588; ADI-18589; ADI-18590; ADI-18591; ADI-18593; ADI-18594; ADI-18595; ADI-18596; ADI-18597; ADI-18592; ADI-18587; ADI-18586; and; ADI-16606; as provided in Table 2.

In certain embodiments, the invention provides an antibody comprising a CD3 binding domain selected from the group consisting of: the CD3 binding domains of ADI-18576; ADI-20820; ADI-20578; ADI-20571; ADI-21097; ADI-20577; ADI-20576; ADI-20568; ADI-20582; ADI-20575; ADI-20567; ADI-20574; ADI-20573; ADI-20579; ADI-18565; ADI-20818; ADI-20587; ADI-20588; ADI-20589; ADI-20590; ADI-20594; ADI-20596; ADI-20599; ADI-20605; ADI-20607; ADI-20608; and ADI-20609; as provided in Table 2.

In certain embodiments, the invention provides an antibody comprising a CD3 binding domain selected from the group consisting of: the CD3 binding domains of ADI-16606; ADI-20587; ADI-20607; ADI-20590; ADI-28708; ADI-28709; ADI-28710; ADI-21943; ADI-28711; ADI-28712; ADI-28713; ADI-28714; ADI-28715; ADI-21944; ADI-28716; ADI-21945; ADI-21946; ADI-28717; ADI-21947; ADI-28718; ADI-28719; ADI-28720; ADI-28721; ADI-28722; ADI-28723; ADI-28724; ADI-28725; ADI-28726; ADI-28727; ADI-28728; ADI-28729; ADI-28730; ADI-28731; ADI-28732; ADI-28733; ADI-28734; ADI-28735; ADI-28736; ADI-28737; ADI-28738; ADI-28739; ADI-28740; ADI-28741; ADI-28742; ADI-28743; ADI-21948; ADI-21949; ADI-28744; ADI-21950; ADI-28745; ADI-28746; ADI-28747; ADI-28748; ADI-21951; ADI-21952; ADI-28749; ADI-28750; ADI-28751; ADI-21953; ADI-28752; ADI-21954; ADI-28753; ADI-28754; ADI-28755; ADI-28756; ADI-28757; ADI-28758; ADI-28759; ADI-28760; ADI-28761; ADI-28762; ADI-28763; ADI-28764; ADI-28765; ADI-28766; ADI-28767; ADI-28768; ADI-21955; ADI-28769; ADI-28770; ADI-21956; ADI-28771; ADI-28772; ADI-28773; ADI-28774; and ADI-28775; as provided in Table 2.

In certain embodiments, the invention provides an antibody comprising a CD3 binding domain selected from the group consisting of: the CD3 binding domains of ADI-21959; ADI-21963; ADI-21965; ADI-21967; ADI-21970; ADI-21971; ADI-21972; ADI-21973; ADI-21974; ADI-21975; ADI-21976; ADI-21977; ADI-21978; ADI-21979; ADI-21943; ADI-21944; ADI-21945; ADI-21946; ADI-21947; ADI-21948; ADI-21949; ADI-21950; ADI-21951; ADI-21952; ADI-21953; ADI-21954; ADI-21955; and ADI-21956; as provided in Table 2.

In certain embodiments, the invention provides an antibody comprising a CD3 binding domain selected from the group consisting of: the CD3 binding domains of ADI-21952; ADI-22523; ADI-24403; ADI-24404; ADI-24405; ADI-24407; ADI-24408; ADI-24409; ADI-24410; ADI-24411; ADI-24412; ADI-24413; ADI-24414; ADI-24415;

ADI-24416; ADI-24417; ADI-24418; ADI-24434; ADI-24435; ADI-24436; ADI-24437; ADI-24438; ADI-24439; ADI-24440; ADI-24441; ADI-24442; ADI-24443; ADI-24444; ADI-24445; ADI-24446; ADI-24449; ADI-24388; ADI-24389; ADI-24390; ADI-24391; ADI-24392; ADI-24393; ADI-24394; ADI-24395; ADI-24396; ADI-24397; ADI-24398; ADI-24399; ADI-24400; ADI-24401; ADI-24402; ADI-24419; ADI-24420; ADI-24421; ADI-24422; ADI-24423; ADI-24424; ADI-24425; ADI-24426; ADI-24427; ADI-24428; ADI-24429; ADI-24430; ADI-24431; ADI-24432; ADI-24433; ADI-24447; and ADI-24448; as provided in Table 2.

In certain embodiments, the invention provides an antibody comprising a CD3 binding domain selected from the group consisting of: the CD3 binding domains of ADI-22523; ADI-23652; ADI-23653; ADI-23654; ADI-23655; ADI-23656; ADI-23657; ADI-23658; ADI-23651; ADI-23644; ADI-23645; ADI-23646; ADI-23647; ADI-23648; ADI-23649; ADI-23650; ADI-23667; ADI-23668; ADI-23669; ADI-23670; ADI-23671; ADI-23672; ADI-23673; ADI-23659; ADI-23660; ADI-23661; ADI-23663; ADI-23664; ADI-23639; ADI-23641; ADI-23642; ADI-23640; ADI-23643; ADI-21952; ADI-23633; ADI-23634; ADI-23635; ADI-23636; ADI-23637; ADI-23638; ADI-23632; and ADI-23629; as provided in Table 2.

In certain embodiments, the invention provides an antibody comprising a CD3 binding domain selected from the group consisting of: the CD3 binding domains of ADI-22523; ADI-26906; ADI-26907; ADI-26908; ADI-26909; ADI-26910; ADI-26912; ADI-26913; ADI-26915; ADI-26916; ADI-26917; ADI-26918; ADI-26919; ADI-26920; ADI-26921; ADI-26924; ADI-26925; ADI-26927; ADI-26928; ADI-26929; ADI-26930; ADI-26932; ADI-26933; ADI-26938; ADI-26939; ADI-26940; ADI-26941; ADI-26942; ADI-26943; ADI-26944; ADI-26945; ADI-26950; ADI-26954; ADI-23672; ADI-23673; ADI-23664; ADI-26955; ADI-26956; ADI-26957; ADI-26958; ADI-26959; ADI-26960; ADI-26962; ADI-26963; ADI-26964; ADI-26965; ADI-26966; ADI-26968; ADI-26969; ADI-26971; ADI-26972; ADI-26973; ADI-26974; ADI-26975; ADI-26976; ADI-26977; ADI-26978; ADI-26979; ADI-26980; ADI-26981; ADI-26982; ADI-26983; ADI-26984; ADI-26985; ADI-26986; ADI-26987; ADI-26988; ADI-26989; ADI-26990; ADI-26991; ADI-26992; ADI-26993; ADI-26994; and ADI-26995; as provided in Table 2.

In certain embodiments, the invention provides an antibody comprising a CD3 binding domain selected from the group consisting of: the CD3 binding domains of ADI-22523; ADI-26906; ADI-26907; ADI-26908; ADI-26910; ADI-26913; ADI-26915; ADI-26919; ADI-26920; ADI-26921; ADI-26943; ADI-26954; ADI-21952; ADI-26955; ADI-26956; ADI-26962; ADI-26978; ADI-26983; and ADI-26994; as provided in Table 2.

In certain embodiments, the invention provides an antibody comprising a CD3 binding domain selected from the group consisting of: ADI-15512; ADI-16513; ADI-15516; ADI-18565; ADI-18589; ADI-18585; ADI-18590; ADI-18576; ADI-20568; ADI-20580; ADI-21978; ADI-22523; ADI-25133; and ADI-26906.

In certain embodiments, the invention provides an antibody comprising a CD3 binding domain selected from the group consisting of: ADI-16606; ADI-29601; ADI-29602; ADI-29603; ADI-20587; ADI-20607; ADI-20590; ADI-21952; ADI-23633; ADI-26955; ADI-26956; ADI-26957; ADI-26958; ADI-26959; ADI-26960; ADI-26961; ADI-26962; ADI-26963; ADI-26964; ADI-26965; ADI-26966; ADI-26967; ADI-26968; ADI-26969; ADI-26970; ADI-26971; ADI-26972; ADI-26973; ADI-26974; ADI-26975; ADI-26976; ADI-26977; ADI-26978; ADI-26979; ADI-26980; ADI-26981; ADI-26982; ADI-26983; ADI-26984; ADI-26985; ADI-26986; ADI-26987; ADI-26988; ADI-26989; ADI-26990; ADI-26991; ADI-26992; ADI-26993; and ADI-26994.

In certain embodiments, the invention provides an antibody comprising a CD3 binding domain selected from the group consisting of: ADI-32238, ADI-32241, ADI-32244, ADI-32247, ADI-32250, ADI-32253, ADI-32256, ADI-32259, ADI-32239, ADI-32242, ADI-32245, ADI-32248, ADI-32251, ADI-32254, ADI-32257, ADI-32260, ADI-32240, ADI-32243, ADI-32246, ADI-32249, ADI-32252, ADI-32255, ADI-32258, and ADI-32261.

In certain embodiments, the invention provides an antibody comprising a CD3 binding domain selected from the group consisting of: ADI-29295, ADI-32249, ADI-29298, ADI-29300, and ADI-26915.

In certain embodiments either alone or in combination with other embodiments of the invention, the inventive CD3 binding domains and antibodies comprising them display a decreased propensity for degradation relative to one or more of: trastuzumab; (Herceptin®); lintuzumab; blinatumomab (Blincyto®); and Mab 364, Mab366, Mab 367, Mab 368, Mab 369, Mab 370, or Mab 22, as provided in Table 2.

In certain embodiments either alone or in combination with other embodiments of the invention, the inventive CD3 binding domains and antibodies comprising them display a decreased CRS risk profile relative to one or more of: trastuzumab; (Herceptin®); lintuzumab; blinatumomab (Blincyto®); and Mab 364, Mab366, Mab 367, Mab 368, Mab 369, Mab 370, or Mab 22, as provided in Table 2.

In certain embodiments and/or in combination with any of the embodiments disclosed herein and throughout, provided are CD3 binding domains and antibodies comprising them that are humanized. In certain embodiments, such CD3 binding domains comprise CDRs of such other embodiments, and further comprise an acceptor human framework, e.g., a human immunoglobulin framework or a human consensus framework.

In certain embodiments and/or in combination with any of the embodiments disclosed herein and throughout provided are CD3 binding domains and antibodies comprising them comprising a VH as in any of the embodiments provided herein and throughout, and a VL as in any of the embodiments provided herein and throughout, wherein one or both of the variable domain sequences include post-translational modifications.

In a further aspect of the invention, provided are CD3 binding domains and antibodies comprising them that bind to the same epitope as a CD3 binding domain provided in the other embodiments disclosed therein and throughout.

In certain embodiments, CD3 binding domains and/or antibodies comprising them have a CD3 dissociation constant (Kd) of $\leq 1$ µM, $\leq 100$ nM, $\leq 10$ nM, $\leq 1$ nM, $\leq 0.1$ nM, $\leq 0.01$ nM, or $\leq 0.001$ nM (e.g., $10^{-8}$ M or less, e.g., from $10^{-8}$ M to $10^{-13}$ M, e.g., from $10^{-9}$ M to $10^{-13}$M).

In certain embodiments, Kd is measured by: biolayer interferometry (BLI), surface plasmon resonance (SPR), solution equilibrium based kinetic exclusion assays, KinExA direct association, assays using FORTEBIO instruments and reagents, such as Octet RED 384 and HTX BLI-based instruments, enzyme-linked immunosorbent assays (ELISA), or radioimmunoassay (RIA). In certain embodiments, the Kd measurement is performed with the Fab version of an inventive CD3 binding domain or antibody comprising it. For example, solution binding affinity of Fabs for antigen is measured by equilibrating Fab with a minimal concentration of (125I)-labeled antigen in the presence of a titration series of unlabeled antigen, then capturing bound antigen with an anti-Fab antibody-coated plate (see, e.g., Chen et al., J. Mol. Biol. 293:865-881 (1999)). To establish conditions for the assay, MICROTITER® multi-well plates (Thermo Scientific) are coated overnight with 5 µg/ml of a capturing anti-Fab antibody (Cappel Labs) in 50 mM sodium carbonate (pH 9.6), and subsequently blocked with 2% (w/v) bovine serum albumin in PBS for two to five hours at room temperature (approximately 23° C.). In a non-adsorbent plate (Nunc #269620), 100 pM or 26 pM [125I]-antigen are mixed with serial dilutions of a Fab of interest (e.g., consistent with assessment of the anti-VEGF antibody, Fab-12, in Presta et al., Cancer Res. 57:4593-4599 (1997)). The Fab of interest is then incubated overnight; however, the incubation may continue for a longer period (e.g., about 65 hours) to ensure that equilibrium is reached. Thereafter, the mixtures are transferred to the capture plate for incubation at room temperature (e.g., for one hour). The solution is then removed and the plate washed eight times with 0.1% polysorbate 20 (TWEEN-20®) in PBS. When the plates have dried, 150 dl/well of scintillant (MICROSCINT-20™; Packard) is added, and the plates are counted on a TOPCOUNT™ gamma counter (Packard) for ten minutes. Concentrations of each Fab that give less than or equal to 20% of maximal binding are chosen for use in competitive binding assays.

In other embodiments, Kd is measured using a BIA-CORE® surface plasmon resonance assay. For example, an assay using a BIACORE®-2000 or a BIACORE®-3000 (BIACORE, Inc., Piscataway, N.J.) is performed at 25° C. with immobilized antigen CM5 chips at ~10 response units (RU). In one embodiment, carboxymethylated dextran biosensor chips (CM5, BIACORE, Inc.) are activated with N-ethyl-N'-(3-dimethylaminopropyl)-carbodiimide hydrochloride (EDC) and N-hydroxysuccinimide (NHS) according to the supplier's instructions. Antigen is diluted with 10 mM sodium acetate, pH 4.8, to 5 µg/ml (~0.2 µM) before injection at a flow rate of 5 l/minute to achieve approximately 10 response units (RU) of coupled protein. Following the injection of antigen, 1 M ethanolamine is injected to block unreacted groups. For kinetics measurements, two-fold serial dilutions of Fab (0.78 nM to 500 nM) are injected in PBS with 0.05% polysorbate 20 (TWEEN-20™) surfactant (PBST) at 25° C. at a flow rate of approximately 25 µl/min. Association rates ($k_{on}$) and dissociation rates (KO are calculated using a simple one-to-one Langmuir binding model (BIACORE® Evaluation Software version 3.2) by simultaneously fitting the association and dissociation sensorgrams. The equilibrium dissociation constant (Kd) is calculated as the ratio kon/koff. See, for example, Chen et al., J. Mol. Biol. 293:865-881 (1999). If the on-rate exceeds 106 M-1 s-1 by the surface plasmon resonance assay above, then the on-rate can be determined by using a fluorescent quenching technique that measures the increase or decrease in fluorescence emission intensity (excitation=295 nm; emission=340 nm, 16 nm band-pass) at 25° C. of a 20 nM anti-antigen antibody (Fab form) in PBS, pH 7.2, in the presence of increasing concentrations of antigen as measured in a spectrometer, such as a stop-flow equipped spectrophotometer (Aviv Instruments) or a 8000-series SLM-AMINC spectrophotometer (THERMOSPECTRONIC) with a stirred cuvette.

In certain embodiments, the inventive CD3 binding domains and antibodies comprising them comprise an antibody fragment. Antibody fragments include, but are not limited to, Fab, Fab', Fab'-SH, F(ab')$_2$, Fv, and scFv fragments, and other fragments described herein and throughout. For a review of certain antibody fragments, see, e.g., Hudson et al. Nat. Med. 9:129-134 (2003). For a review of scFv fragments, see, e.g., Pluckthün, in The Pharmacology of Monoclonal Antibodies, vol. 113, Rosenburg and Moore eds., (Springer-Verlag, New York), pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869,046.

Diabodies are antibody fragments with two antigen-binding sites that may be bivalent or bispecific. See, for example, EP 404,097; WO 1993/01161; Hudson et al. Nat. Med. 9:129-134 (2003); and Hollinger et al. Proc. Natl. Acad. Sci. USA 90: 6444-6448 (1993). Triabodies and tetrabodies are also described in Hudson et al. Nat. Med. 9:129-134 (2003).

Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, Mass.; see, e.g., U.S. Pat. No. 6,248,516 B1).

Antibody fragments can be made by various techniques, including but not limited to proteolytic digestion of an intact antibody as well as production by recombinant host cells (e.g. E. coli or phage), as described herein.

In certain embodiments, the inventive CD3 binding domains and antibodies comprising them comprise a chimeric antibody. Certain chimeric antibodies are described, e.g., in U.S. Pat. No. 4,816,567; and Morrison et al. Proc. Natl. Acad. Sci. USA, 81:6851-6855 (1984)). In one example, a chimeric antibody comprises a non-human variable region (e.g., a variable region derived from a mouse, rat, hamster, rabbit, or non-human primate, such as a monkey) and a human constant region. In a further example, a chimeric antibody is a "class switched" antibody in which the class or subclass has been changed from that of the parent antibody. Chimeric antibodies include antigen-binding fragments thereof.

In certain embodiments, the inventive CD3 binding domains and antibodies comprising them comprise a chimeric antibody that is a humanized antibody. Typically, a non-human antibody is humanized to reduce immunogenicity to humans, while retaining the specificity and affinity of the parental non-human antibody. Generally, a humanized antibody comprises one or more variable domains in which CDRs (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the CDR residues are derived), e.g., to restore or improve antibody specificity, affinity, lack or immunogenicity, stability, developability profile, CRS risk, and the like.

Humanized antibodies and methods of making them are reviewed, e.g., in Almagro and Fransson, Front. Biosci. 13:1619-1633 (2008), and are further described, e.g., in Riechmann et al., Nature 332:323-329 (1988); Queen et al., Proc. Nat'l Acad. Sci. USA 86:10029-10033 (1989); U.S. Pat. Nos. 5,821,337, 7,527,791, 6,982,321, and 7,087,409; Kashmiri et al., Methods 36:25-34 (2005) (describing specificity determining region (SDR) grafting); Padlan, Mol. Immunol. 28:489-498 (1991) (describing "resurfacing");

Dall'Acqua et al., Methods 36:43-60 (2005) (describing "FR shuffling"); and Osbourn et al., Methods 36:61-68 (2005) and Klimka et al., Br. J. Cancer, 83:252-260 (2000) (describing the "guided selection" approach to FR shuffling).

Human framework regions that may be used for humanization include but are not limited to: framework regions selected using the "best-fit" method (see, e.g., Sims et al. J. Immunol. 151:2296 (1993)); framework regions derived from the consensus sequence of human antibodies of a particular subgroup of light or heavy chain variable regions (see, e.g., Carter et al. Proc. Natl. Acad. Sci. USA, 89:4285 (1992); and Presta et al. J. Immunol., 151:2623 (1993)); human mature (somatically mutated) framework regions or human germline framework regions (see, e.g., Almagro and Fransson, Front. Biosci. 13:1619-1633 (2008)); and framework regions derived from screening FR libraries (see, e.g., Baca et al., J. Biol. Chem. 272:10678-10684 (1997) and Rosok et al., J. Biol. Chem. 271:22611-22618 (1996)).

In certain embodiments, the inventive CD3 binding domains and antibodies comprising them comprise a human antibody. Human antibodies can be produced using various techniques known in the art. Human antibodies are described generally in van Dijk and van de Winkel, Curr. Opin. Pharmacol. 5: 368-74 (2001) and Lonberg, Curr. Opin. Immunol. 20:450-459 (2008).

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic mice, the endogenous immunoglobulin loci have generally been inactivated. For review of methods for obtaining human antibodies from transgenic animals, see Lonberg, Nat. Biotech. 23:1117-1125 (2005). See also, e.g., U.S. Pat. Nos. 6,075,181 and 6,150,584 describing XENO-MOUSE technology; U.S. Pat. No. 5,770,429 describing HUMAB® technology; U.S. Pat. No. 7,041,870 describing K-M MOUSE® technology, and U.S. Patent Application Publication No. US 2007/0061900, describing VELOCI-MOUSE® technology). Human variable regions from intact antibodies generated by such animals may be further modified, e.g., by combining with a different human constant region.

Human antibodies can also be made by hybridoma-based methods. Human myeloma and mouse-human heteromyeloma cell lines for the production of human monoclonal antibodies have been described. (See, e.g., Kozbor J. Immunol., 133: 3001 (1984); Brodeur et al., Monoclonal Antibody Production Techniques and Applications, pp. 51-63 (Marcel Dekker, Inc., New York, 1987); and Boerner et al., J. Immunol., 147: 86 (1991).) Human antibodies generated via human B-cell hybridoma technology are also described in Li et al., Proc. Natl. Acad. Sci. LISA. 103; 3557-3562 (2006). Additional methods include those described, for example, in U.S. Pat. No. 7,189,826 (describing production of monoclonal human IgM antibodies from hybridoma cell lines) and Ni, Xiandai Mianyixue, 26(4):265-268 (2006) (describing human-human hybridomas). Human hybridoma technology (Trioma technology) is also described in Vollmers and Brandlein, Histology and Histopathology, 20(3):927-937 (2005) and Vollmers and Brandlein, Methods and Findings in Experimental and Clinical Pharmacology, 27(3):185-91 (2005).

Human antibodies may also be generated by isolating Fv clone variable domain sequences selected from human-derived phage display libraries. Such variable domain sequences may then be combined with a desired human constant domain. Techniques for selecting human antibodies from antibody libraries are described herein and throughout.

Antibodies of the invention may be isolated by screening combinatorial libraries for antibodies with the desired activity or activities. For example, a variety of methods are known in the art for generating phage display libraries and screening such libraries for antibodies possessing the desired binding characteristics. Such methods are reviewed, e.g., in Hoogenboom et al. in Methods in Molecular Biology 178: 1-37 (O'Brien et al., ed., Human Press, Totowa, N.J., 2001) and further described, e.g., in the McCafferty et al., Nature 348:552-554; Clackson et al., Nature 352: 624-628 (1991); Marks et al., J. Mol. Biol. 222: 581-597 (1992); Marks and Bradbury, in Methods in Molecular Biology 248:161-175 (Lo, ed., Human Press, Totowa, N.J., 2003); Sidhu et al., J. Mol. Biol. 338(2): 299-310 (2004); Lee et al., J. Mol. Biol. 340(5): 1073-1093 (2004); Fellouse, Proc. Natl. Acad. Sci. USA 101(34): 12467-12472 (2004); and Lee et al., J. Immunol. Methods 284(1-2): 119-132(2004).

In certain embodiments, the inventive CD3 binding domains and antibodies comprising them may be selected from yeast-based antibody libraries, such as those disclosed in, e.g., WO 2009/0363379; WO 2010/105256; and WO 2012/009568. In certain embodiments, the inventive CD3 binding domains and antibodies comprising them may be optimized (also known as "affinity matured) as disclosed herein and throughout as well as in WO 2009/0363379; WO 2010/105256; and WO 2012/009568 and via other techniques available in the art.

In certain phage display methods, repertoires of VH and VL genes are separately cloned by polymerase chain reaction (PCR) and recombined randomly in phage libraries, which can then be screened for antigen-binding phage as described in Winter et al., Ann. Rev. Immunol., 12: 433-455 (1994). Phage typically display antibody fragments, either as single-chain Fv (scFv) fragments or as Fab fragments. Libraries from immunized sources provide high-affinity antibodies to the immunogen without the requirement of constructing hybridomas. Alternatively, the naive repertoire can be cloned (e.g., from human) to provide a single source of antibodies to a wide range of non-self and also self antigens without any immunization as described by Griffiths et al., EMBO J, 12: 725-734 (1993). Finally, naive libraries can also be made synthetically by cloning unrearranged V-gene segments from stem cells and using PCR primers containing random sequence to encode the highly variable CDR3 regions and to accomplish rearrangement in vitro, as described by Hoogenboom and Winter, J. Mol. Biol., 227: 381-388 (1992). Patent publications describing human antibody phage libraries include, for example: U.S. Pat. No. 5,750,373, and US Patent Publication Nos. 2005/0079574, 2005/0119455, 2005/0266000, 2007/0117126, 2007/0160598, 2007/0237764, 2007/0292936, and 2009/0002360.

Antibodies or antibody fragments isolated from human antibody libraries are considered human antibodies or human antibody fragments herein.

In certain embodiments, the inventive CD3 binding domains and antibodies comprising them comprise a multispecific antibody, for example, a bispecific antibody. Multispecific antibodies are monoclonal antibodies that have binding specificities for at least two different antigens, or at least two different epitopes present on the same antigen. In certain embodiments, bispecific antibodies may bind to two different epitopes of CD3 (e.g., CD3ε or CD3γ). In certain embodiments, one of the binding specificities is for CD3 (e.g., CD3ε or CD3γ) and the other is for any other antigen (e.g., a second biological molecule, e.g., a cell surface antigen, e.g., a tumor antigen). Accordingly, a bispecific anti-CD3 antibody may have binding specificities for CD3 and a second biological molecule, such as a second biological molecule (e.g., a tumor antigen) listed in Table 1 and described in U.S. Pub. No. 2010/0111856. In certain embodiments, the inventive CD3 binding domains and antibodies comprising them comprise a multispecific antibody, for example, a bispecific antibody wherein the multispecific antibody comprises a second binding domain having specificity for a second antigen, such as: a human leukocyte antigen (HLA)-peptide complex presented on the cell surface by MHC.

In certain embodiments, the inventive CD3 binding domains and antibodies comprising them comprise a multispecific antibody, for example, a bispecific antibody wherein the multispecific antibody comprises a second binding domain having specificity for a second antigen selected from the group consisting of: 0772P (CA125, MUC16; Genbank accession no. AF36148); adipophilin (perilipin-2, Adipose differentiation-related protein, ADRP, ADFP, MGC10598; NCBI Reference Sequence: NP-001113.2); AIM-2 (Absent In Melanoma 2, PYHIN4, Interferon-Inducible Protein AIM2; NCBI Reference Sequence: NP-004824.1); ALDH1 A1 (Aldehyde Dehydrogenase 1 Family, Member A1, ALDH1, PUMB 1, Retinaldehyde Dehydrogenase 1, ALDC, ALDH-E1, ALHDII, RALDH 1, EC 1.2.1.36, ALDH11, HEL-9, HEL-S-53e, HEL12, RALDH1, Acetaldehyde Dehydrogenase 1, Aldehyde Dehydrogenase 1, Soluble, Aldehyde Dehydrogenase, Liver Cytosolic, ALDH Class 1, Epididymis Luminal Protein 12, Epididymis Luminal Protein 9, Epididymis Secretory Sperm Binding Protein Li 53e, Retinal Dehydrogenase 1, RaIDH1, Aldehyde Dehydrogenase Family 1 Member A1, Aldehyde Dehydrogenase, Cytosolic, EC 1.2.1; NCBI Reference Sequence: NP-000680.2); alpha-actinin-4 (ACTN4, Actinin, Alpha 4, FSGS1, Focal Segmental Glomerulosclerosis 1, Non-Muscle Alpha-Actinin 4, F-Actin Cross-Linking Protein, FSGS, ACTININ-4, Actinin Alpha4 Isoform, alpha-actinin-4; NCBI Reference Sequence: NP-004915.2); alpha-fetoprotein (AFP, HPAFP, FETA, alpha-1-fetoprotein, alpha-fetoglobulin, Alpha-1-fetoprotein, Alpha-fetoglobulin, HP; GenBank: AAB58754.1); Amphiregulin (AREG, SDGF, Schwannoma-Derived Growth Factor, Colorectum Cell-Derived Growth Factor, AR, CRDGF; GenBank: AAA51781.1); ARTC1 (ART1, ADP-Ribosyltransferase 1, Mono(ADP-Ribosyl)Transferase 1, ADP-Ribosyltransferase C2 And C3 Toxin-Like 1, ART2, CD296, RT6, ADP-Ribosyltransferase 2, GPI-Linked NAD(P)(+)-Arginine ADP-Ribosyltransferase 1, EC 2.4.2.31, CD296 Antigen; NP); ASLG659; ASPHDI (Aspartate Beta-Hydroxylase Domain Containing 1, Aspartate Beta-Hydroxylase Domain-Containing Protein 1, EC 1.14.11.-, EC 1.14.11; GenBank: AAI44153.1); B7-H4 (VTCN1, V-Set Domain Containing T Cell Activation Inhibitor 1, B7H4, B7 Superfamily Member 1, Immune Costimulatory Protein B7-H4, B7h.5, T-Cell Costimulatory Molecule B7x, B7S1, B7X, VCTN1, H4, B7 Family Member, PRO1291, B7 Family Member, H4, T Cell Costimulatory Molecule B7x, V-Set Domain-Containing T-Cell Activation Inhibitor 1, Protein B7S1; GenBank: AAZ17406.1); BAFF-R (TNFRSF13C, Tumor Necrosis Factor Receptor Superfamily, Member 13C, BAFFR, B-Cell-Activating Factor Receptor, BAFF Receptor, BLyS Receptor 3, CVID4, BROMIX, CD268, B Cell-Activating Factor Receptor, prolixin, Tumor Necrosis Factor Receptor Superfamily Member 13C, BR3, CD268 Antigen; NCBI Reference Sequence: NP-443177.1); BAGE-1; BCLX (L); BCR-ABL fusion protein (b3a2); beta-catenin (CTNNB1, Catenin (Cadherin-Associated Protein), Beta 1, 88 kDa, CTNNB, MRD19, Catenin (Cadherin-Associated Protein), Beta 1 (88 kD), armadillo, Catenin Beta-1; GenBank: CAA61107.1); BING-4 (WDR46, WD Repeat Domain 46, C6orf11, BING4, WD Repeat-Containing Protein BING4, Chromosome 6 Open Reading Frame 11, FP221, UTP7, WD Repeat-Containing Protein 46; NP); BMPR1 B (bone morphogenetic protein receptor-type IB, Genbank accession no. NM-00120; NP); B-RAF (Brevican (BCAN, BEHAB, Genbank accession no. AF22905); Brevican (BCAN, Chondroitin Sulfate Proteoglycan 7, Brain-Enriched Hyaluronan-Binding Protein, BEHAB, CSPG7, Brevican Proteoglycan, Brevican Core Protein, Chondroitin Sulfate Proteoglycan BEHAB; GenBank: AAH27971.1); CALCA (Calcitonin-Related Polypeptide Alpha, CALC1, Calcitonin 1, calcitonin, Alpha-Type CGRP, Calcitonin Gene-Related Peptide I, CGRP-I, CGRP, CGRP1, CT, KC, Calcitonin/Calcitonin-Related Polypeptide, Alpha, katacalcin; NP); CASP-5 (CASP5, Caspase 5, Apoptosis-Related Cysteine Peptidase, Caspase 5, Apoptosis-Related Cysteine Protease, Protease ICH-3, Protease TY, ICE(rel)-111, ICE (rel)III, ICEREL-III, ICH-3, caspase-5, TY Protease, EC 3.4.22.58, ICH3, EC 3.4.22; NP); CASP-8; CD19 (CD19-B-lymphocyte antigen CD19 isoform 2 precursor, B4, CVID3 [*Homo sapiens*], NCBI Reference Sequence: NP-001761.3); CD20 (CD20-B-lymphocyte antigen CD20, membrane-spanning 4-domains, subfamily A, member 1, B1, Bp35, CD20, CVID5, LEU-16, MS4A2, S7; NCBI Reference Sequence: NP-690605.1); CD21 (CD21 (CR2 (Complement receptor or C3DR (C3d/Epstein Barr virus receptor) or Hs.73792 Genbank accession no. M2600); (CD22 (B-cell receptor CD22-B isoform, BL-CAM, Lyb-8, LybB, SIGLEC-2, FLJ22814, Genbank accession No. AK02646); CD22; CD33 (CD33 Molecule, CD33 Antigen (Gp67), Sialic Acid Binding Ig-Like Lectin 3, Sialic Acid-Binding Ig-Like Lectin 3, SIGLEC3, gp67, SIGLEC-3, Myeloid Cell Surface Antigen CD33, p67, Siglec-3, CD33 Antigen; GenBank: AAH28152.1); CD45; CD70 (CD70-tumor necrosis factor (ligand) superfamily, member 7; surface antigen CD70; Ki-24 antigen; CD27 ligand; CD27-L; tumor necrosis factor ligand superfamily member 7; NCBI Reference Sequence for species *Homo sapiens*: NP-001243.1); CD72 (CD72 (B-cell differentiation antigen CD72, Lyb-; 359 aa, µl: 8.66, MW: 40225, TM: 1 [P] Gene Chromosome: 9p13.3, Genbank accession No. NP-001773.); CD79a (CD79a (CD79A, CD79a, immuno-globulin-associated alpha, a B cell-specific protein that covalently interacts with Ig beta (CD79B) and forms a complex on the surface with Ig M molecules, transduces a signal involved in B-cell differentiation), al: 4.84, MW: 25028 TM: 2 [P] Gene Chromosome: 19q13.2, Genbank accession No. NP-001774.1); CD79b (CD79b (CD79B, CD79b, IGb (immunoglobulin-associated beta), B29, Genbank accession no. NM-000626 or 1103867); Cdc27 (Cell Division Cycle 27, D0S1430E, D17S978E, Anaphase Promoting Complex Subunit 3, Anaphase-Promoting Complex Subunit 3, ANAPC3, APC3, CDC27Hs, H-NUC, CDC27 Homolog, Cell Division Cycle 27 Homolog (S. *Cerevisiae*), HNUC, NUC2, Anaphase-Promoting Complex, Protein 3, Cell Division Cycle 27 Homolog, Cell Division Cycle Protein 27 Homolog, Nuc2 Homolog; GenBank: AAH11656.1); CDK4 (Cyclin-Dependent Kinase 4, Cell Division Protein Kinase 4, PSK-J3, EC 2.7.11.22, CMM3, EC 2.7.11; NCBI Reference Sequence: NP-000066.1); CDKN2A (Cyclin-Dependent Kinase Inhibitor 2A, MLM, CDKN2, MTS1, Cyclin-Dependent Kinase Inhibitor 2A (Melanoma, P16, Inhibits CDK4), Cyclin-Dependent Kinase 4 Inhibitor A, Multiple Tumor Suppressor 1, CDK4I, MTS-1, CMM2, P16, ARF, INK4, INK4A, P14, P14ARF, P16-INK4A, P16INK4, P16INK4A, P19, P19ARF, TP16, CDK4 Inhibitor P16-INK4, Cell Cycle Negative Regulator Beta, p14ARF, p16-INK4, p16-INK4a, p16INK4A, p19ARF; NP); CEA; CLL1 (CLL-1 (CLEC12A, MICL, and DCAL, encodes a member of the C-type lectin/C-type lectin-like domain (CTL/CTLD) superfamily. Members of this family share a common protein fold and have diverse functions, such as cell adhesion, cell-cell signaling, glycoprotein turnover, and roles in inflammation and immune response. The protein encoded by this gene is a negative regulator of granulocyte and monocyte function. Several alternatively spliced transcript variants of this gene have been described, but the full-length nature of some of these variants has not been determined. This gene is closely linked to other CTL/CTLD superfamily members in the natural killer gene complex region on chromosome 12p13 (Drickamer K Curr. Opin. Struct. Biol. 9):585-90; van Rhenen A, et al., Blood 110):2659-66; Chen C H, et al. Blood 107):1459-67; Marshall A S, et al. Eur. J. Immunol. 36):2159-69; Bakker A B, et al Cancer Res. 64:8443-50; Marshall A S, et al J. Biol. Chem. 279:14792-80. CLL-1 has been shown to be a type II transmembrane receptor comprising a single C-type lectin-like domain (which is not predicted to bind either calcium or sugar), a stalk region, a transmembrane domain and a short cytoplasmic tail containing an ITIM motif.); CLPP (Caseinolytic Mitochondrial Matrix Peptidase Proteolytic Subunit, Endopeptidase Clp, EC 3.4.21.92, PRLTS3, ATP-Dependent Protease ClpAP (*E. coli*), ClpP (Caseinolytic Protease, ATP-Dependent, Proteolytic Subunit, *E. coli*) Homolog, ClpP Caseinolytic Peptidase, ATP-Dependent, Proteolytic Subunit Homolog (*E. coli*), ClpP Caseinolytic Protease, ATP-Dependent, Proteolytic Subunit Homolog (*E. coli*), human, Proteolytic Subunit, ATP-Dependent Protease ClpAP, Proteolytic Subunit, Human, ClpP Caseinolytic Peptidase ATP-Dependent, Proteolytic Subunit, ClpP Caseinolytic Peptidase, ATP-Dependent, Proteolytic Subunit Homolog, ClpP Caseinolytic Protease, ATP-Dependent, Proteolytic Subunit Homolog, Putative ATP-Dependent Clp Protease Proteolytic Subunit, Mitochondrial; NP); COA-1; CPSF; CRIPTO (CRIPTO (CR, CR1, CRGF, CRIPTO, TDGF 1, teratocarcinoma-derived growth factor, Genbank accession no. NP-003203 or NM-00321); Cw6; CXCR5 CXCR5 (Burkitt's lymphoma receptor 1, a G protein-coupled receptor that is activated by the CXCL13 chemokine, functions in lymphocyte migration and humoral defense, plays a role in HIV-2 infection and perhaps development of AIDS, lymphoma, myeloma, and leukemia); 372 aa, µl: 8.54 MW: 41959 TM: 7 [P] Gene Chromosome: 11q23.3, Genbank accession No. NP-001707.); CXORF61 CXORF61-chromosome X open reading frame 61[*Homo sapiens*], NCBI Reference Sequence: NP-001017978.1); cyclin D1 (CCND1, BCL1, PRAD1, D11S287E, B-Cell CLL/Lymphoma 1, B-Cell Lymphoma 1 Protein, BCL-1 Oncogene, PRAD1 Oncogene, Cyclin D1 (PRAD1: Parathyroid Adenomatosis 1), G1/S-Specific Cyclin D1, Parathyroid Adenomatosis 1, U21B31, G1/S-Specific Cyclin-D1, BCL-1; NCBI Reference Sequence: NP-444284.1); Cyclin-A1 (CCNA1, CT146, Cyclin A1; GenBank: AAH36346.1); dek-can fusion protein; DKK1 (Dickkopf WNT Signaling Pathway Inhibitor 1, SK, hDkk-1, Dickkopf (*Xenopus laevis*) Homolog 1, Dickkopf 1 Homolog (*Xenopus laevis*), DKK-1, Dickkopf 1 Homolog, Dickkopf Related Protein-1, Dickkopf-1 Like, Dickkopf-Like Protein 1, Dickkopf-Related Protein 1, Dickkopf-1, Dkk-1; GenBank: AAQ89364.1); DR1 (Down-Regulator Of Transcription 1, TBP-Binding (Negative Cofactor 2), Negative Cofactor 2-Beta, TATA-Binding Protein-Associated Phosphoprotein, NC2, NC2-BETA, Protein Dr1, NC2-beta, Down-Regulator Of Transcription 1; NCBI Reference Sequence: NP-001929.1); DR13 (Major Histocompatibility Complex, Class II, DR Beta 1, HLA-DR1B, DRw10, DW2.2/DR2.2, SS1, DRB1, HLA-DRB, HLA Class II Histocompatibility Antigen, DR-1 Beta Chain, Human Leucocyte Antigen DRB1, Lymphocyte Antigen DRB1, MHC Class II Antigen, MHC Class II HLA-DR Beta 1 Chain, MHC Class II HLA-DR-Beta Cell Surface Glycoprotein, MHC Class II HLA-DRw10-Beta, DR-1, DR-12, DR-13, DR-14, DR-16, DR-4, DR-5, DR-7, DR-8, DR-9, DR1, DR12, DR13, DR14, DR16, DR4, DR5, DR7, DRB, DR9, DRw11, DRw8, HLA-DRB2, Clone P2-Beta-3, MHC Class II Antigen DRB1*1, MHC Class II Antigen DRB1*10, MHC Class II Antigen DRB1*11, MHC Class II Antigen DRB1*12, MHC Class II Antigen DRB1*13, MHC Class II Antigen DRB1*14, MHC Class II Antigen DRB1*15, MHC Class II Antigen DRB1*16, MHC Class II Antigen DRB1*3, MHC Class II Antigen DRB1*4, MHC Class II Antigen DRB1*7, MHC Class II Antigen DRB1*8, MHC Class II Antigen DRB1*9; NP); E16 (E16 (LAT1, SLC7A5, Genbank accession no. NM-00348); EDAR (EDAR—tumor necrosis factor receptor superfamily member EDAR precursor, EDA-A1 receptor; downless homolog; ectodysplasin-A receptor; ectodermal dysplasia receptor; anhidrotic ectodysplasin receptor 1, DL; ECTD10A; ECTD10B; ED1R; ED3; ED5; EDA-A1R; EDA1R; EDA3; HRM1 [*Homo sapiens*]; NCBI Reference Sequence: NP-071731.1); EFTUD2 (Elongation Factor Tu GTP Binding Domain Containing 2, Elongation Factor Tu GTP-Binding Domain-Containing Protein 2, hSNU114, SNU114 Homolog, U5 SnRNP-Specific Protein, 116 KDa, MFDGA, KIAA0031, 116 KD, U5 SnRNP Specific Protein, 116 KDa U5 Small Nuclear Ribonucleoprotein Component, MFDM, SNRNP116, Snrp116, Snu114, U5-116KD, SNRP116, U5-116 KDa; GenBank: AAH02360.1); EGFR (Epidermal Growth Factor Receptor, ERBB, Proto-Oncogene C-ErbB-1, Receptor Tyrosine-Protein Kinase ErbB-1, ERBB1, HER1, EC 2.7.10.1, Epidermal Growth Factor Receptor (Avian Erythroblastic Leukemia Viral (V-Erb-B) Oncogene Homolog), Erythroblastic Leukemia Viral (V-Erb-B) Oncogene Homolog (Avian), P1G61, Avian Erythroblastic Leukemia Viral (V-Erb-B) Oncogene Homolog, Cell Growth Inhibiting Protein 40, Cell Proliferation-Inducing Protein 61, mENA, EC 2.7.10; GenBank: AAH94761.1); EGFR-G719A; EGFR-G719C; EGFR-G719S; EGFR-L858R; EGFR-L861 Q; EGFR-57681; EGFR-T790M; Elongation factor 2 (EEF2, Eukaryotic Translation Elongation Factor 2, EF2, Polypeptidyl-TRNA Translocase, EF-2, SCA26, EEF-2; NCBI Reference Sequence: NP-001952.1); ENAH (hMena) (Enabled Homolog (*Drosophila*), MENA, Mammalian Enabled, ENA, NDPP1, Protein Enabled Homolog; GenBank: AAH95481.1)-results for just "ENAH" not "ENAH (hMena)"; EpCAM (Epithelial Cell Adhesion Molecule, M4S1, MIC 18, Tumor-Associated Calcium Signal Transducer 1, TACSTD1, TROP1, Adenocarcinoma-Associated Antigen, Cell Surface Glycoprotein Trop-1, Epithelial Glycoprotein 314, Major Gastrointestinal Tumor-Associated Protein GA733-2, EGP314, KSA, DIAR5, HNPCC8, Antigen Identified By Monoclonal Antibody AUA1, EGP-2, EGP40, ESA, KS 1/4, MK-1, Human Epithelial Glycoprotein-2, Membrane Component, Chromosome 4, Surface Marker (35 kD Glycoprotein), EGP, Ep-CAM, GA733-2, M1S2, CD326 Antigen, Epithelial Cell Surface Antigen, hEGP314, KS 1/4 Antigen, ACSTD1; GenBank: AAH14785.1); EphA3 (EPH Receptor A3, ETK1, ETK, TYRO4, HEK, Eph-Like Tyrosine Kinase 1, Tyrosine-Protein Kinase Receptor ETK1, EK4, EPH-Like Kinase 4, EC 2.7.10.1, EPHA3, HEK4, Ephrin Type-A Receptor 3, Human Embryo Kinase 1, TYRO4 Protein Tyrosine Kinase, hEK4, Human Embryo Kinase, Tyrosine-Protein Kinase TYRO4, EC 2.7.10; GenBank: AAH63282.1); EphB2R; Epiregulin (EREG, ER, proepiregulin; GenBank: AAI36405.1); ETBR (EDNRB, Endothelin Receptor Type B, HSCR2, HSCR, Endothelin Receptor Non-Selective Type, ET-B, ET-BR, ETRB, ABCDS, WS4A, ETB, Endothelin B Receptor; NP); ETV6-AML1 fusion protein; EZH2 (Enhancer Of Zeste Homolog 2 (*Drosophila*), Lysine N-Methyltransferase 6, ENX-1, KMT6 EC 2.1.1.43, EZH1, WVS, Enhancer Of Zeste (*Drosophila*) Homolog 2, ENX1, EZH2b, KMT6A, WVS2, Histone-Lysine N-Methyltransferase EZH2, Enhancer Of Zeste Homolog 2, EC 2.1.1; GenBank: AAH10858.1); FcRH1 (FCRL1, Fc Receptor-Like 1, FCRH1, Fc Receptor Homolog 1, FcR-Like Protein 1, Immune Receptor Translocation-Associated Protein 5, IFGP1, IRTA5, hIFGP1, IFGP Family Protein 1, CD307a, Fc Receptor-Like Protein 1, Immunoglobulin Superfamily Fc Receptor, Gp42, FcRL1, CD307a Antigen; GenBank: AAH33690.1); FcRH2 (FCRL2, Fc Receptor-Like 2, SPAP1, SH2 Domain-Containing Phosphatase Anchor Protein 1, Fc Receptor Homolog 2, FcR-Like Protein 2, Immunoglobulin Receptor Translocation-Associated Protein 4, FCRH2, IFGP4, IRTA4, IFGP Family Protein 4, SPAP1A, SPAP1 B, SPAP1C, CD307b, Fc Receptor-Like Protein 2, Immune Receptor Translocation-Associated Protein 4, Immunoglobulin Superfamily Fc Receptor, Gp42, SH2 Domain Containing Phosphatase Anchor Protein 1, FcRL2, CD307b Antigen; GenBank: AAQ88497.1); FcRH5 (FCRL5, Fc Receptor-Like 5, IRTA2, Fc Receptor Homolog 5, FcR-Like Protein 5, Immune Receptor Translocation-Associated Protein 2, BXMAS1, FCRH5, CD307, CD307e, PRO820, Fc Receptor-Like Protein 5, Immunoglobulin Superfamily Receptor Translocation Associated 2 (IRTA2), FCRL5, CD307e Antigen; GenBank: AAI01070.1); FLT3-ITD; FN1 (Fibronectin 1, Cold-Insoluble Globulin, FN, Migration-Stimulating Factor, CIG, FNZ, GFND2, LETS, ED-B, FINC, GFND, MSF, fibronectin; GenBank: AAI43764.1); G250 (MN, CAIX, Carbonic Anhydrase IX, Carbonic Dehydratase, RCC-Associated Protein G250, Carbonate Dehydratase IX, Membrane Antigen MN, Renal Cell Carcinoma-Associated Antigen G250, CA-IX, P54/58N, pMW1, RCC-Associated Antigen G250, Carbonic Anhydrase 9; NP); —alias results for "G250" not "G250/MN/CAIX"; GAGE-1,2,8; GAGE-3,4,5,6,7; GDNF-Ra1 (GDNF family receptor alpha 1; GFRA1; GDNFR; GDNFRA; RETL1; TRNR1; RET1 L; GDNFR-alpha1; GFR-ALPHA-; U95847; BC014962; NM-145793 NM-005264); GEDA (Genbank accession No. AY26076); GFRA1-GDNF family receptor alpha-1; GDNF receptor alpha-1; GDNFR-alpha-1; GFR-alpha-1; RET ligand 1; TGF-beta-related neurotrophic factor receptor 1 [*Homo sapiens*]; ProtKB/Swiss-Prot: P56159.2; glypican-3 (GPC3, Glypican 3, SDYS, Glypican Proteoglycan 3, Intestinal Protein OCI-5, GTR2-2, MXR7, SGBS1, DGSX, OCI-5. SGB, SGBS, Heparan Sulphate Proteoglycan, Secreted Glypican-3, OCI5; GenBank: AAH35972.1); GnTVf; gp100 (PMEL, Premelanosome Protein, SILV, D12S53E, PMEL17, SIL, Melanocyte Protein Pmel 17, Melanocytes Lineage-Specific Antigen GP100, Melanoma-Associated ME20 Antigen, Silver Locus Protein Homolog, ME20-M, ME20M, P1, P100, Silver (Mouse Homolog) Like, Silver Homolog (Mouse), ME20, SI, Melanocyte Protein Mel 17, Melanocyte Protein PMEL, Melanosomal Matrix Protein17, Silver, Mouse, Homolog Of; GenBank: AAC60634.1); GPC; GPNMB (Glycoprotein (Transmembrane) Nmb, Glycoprotein NMB, Glycoprotein Nmb-Like Protein, osteoactivin, Transmembrane Glycoprotein HGFIN, HGFIN, NMB, Transmembrane Glycoprotein, Transmembrane Glycoprotein NMB; GenBank: AAH32783.1); GPR172A (G protein-coupled receptor 172A; GPCR41; FLJ11856; D15Ertd747e); NP-078807.1; NM-024531.3); GPR19 (G protein-coupled receptor 19; Mm.478; NP-006134.1; NM-006143.2); GPR54 (KISS1 receptor; KISS1R; GPR54; HOT7T175; AXOR1; NP-115940.2; NM-032551.4); HAVCR1 (Hepatitis A Virus Cellular Receptor 1, T-Cell Immunoglobulin Mucin Family Member 1, Kidney Injury Molecule 1, KIM-1, KIM1, TIM, TIM-1, TIM1, TIMD-1, TIMD1, T-Cell Immunoglobulin Mucin Receptor 1, T-Cell Membrane Protein 1, HAVCR, HAVCR-1, T Cell Immunoglobin Domain And Mucin Domain Protein 1, HAVcr-1, T-Cell Immunoglobulin And Mucin Domain-Containing Protein 1; GenBank: AAH13325.1); HER2 (ERBB2, V-Erb-B2 Avian Erythroblastic Leukemia Viral Oncogene Homolog 2, NGL, NEU, Neuro/Glioblastoma Derived Oncogene Homolog, Metastatic Lymph Node Gene 19 Protein, Proto-Oncogene C-ErbB-2, Proto-Oncogene Neu, Tyrosine Kinase-Type Cell Surface Receptor HER2, MLN 19, p185erbB2, EC 2.7.10.1, V-Erb-B2 Avian Erythroblastic Leukemia Viral Oncogene Homolog 2 (Neuro/Glioblastoma Derived Oncogene Homolog), CD340, HER-2, HER-2/neu, TKR1, C-Erb B2/Neu Protein, herstatin, Neuroblastoma/Glioblastoma Derived Oncogene Homolog, Receptor Tyrosine-Protein Kinase ErbB-2, V-Erb-B2 Erythroblastic Leukemia Viral Oncogene Homolog 2, Neuro/Glioblastoma Derived Oncogene Homolog, MLN19, CD340 Antigen, EC 2.7.10; NP); HER-2/neu-alias of above; HERV-K-MEL; HLA-DOB (Beta subunit of MHC class II molecule (1a antigen) that binds peptides and presents them to CD4+ T lymphocytes); 273 aa, μl: 6.56, MW: 30820.TM: 1 [P] Gene Chromosome: 6p21.3, Genbank accession No. NP-002111); hsp70-2 (HSPA2, Heat Shock 70 kDa Protein 2, Heat Shock 70 kD Protein 2, HSP70-3, Heat Shock-Related 70 KDa Protein 2, Heat Shock 70 KDa Protein 2; GenBank: AAD21815.1); IDO1 (Indoleamine 2,3-Dioxygenase 1, IDO, INDO, Indoleamine-Pyrrole 2,3-Dioxygenase, IDO-1, Indoleamine-Pyrrole 2,3 Dioxygenase, Indolamine 2,3 Dioxygenase, Indole 2,3 Dioxygenase, EC 1.13.11.52; NCBI Reference Sequence: NP-002155.1); IGF2B3; IL13Ralpha2 (IL13RA2, Interleukin 13 Receptor, Alpha 2, Cancer/Testis Antigen 19, Interleukin-13-Binding Protein, IL-13R-alpha-2, IL-13RA2, IL-13 Receptor Subunit Alpha-2, IL-13R Subunit Alpha-2, CD213A2, CT19, IL-13R, IL13BP, Interleukin 13 Binding Protein, Interleukin 13 Receptor Alpha 2 Chain, Interleukin-13 Receptor Subunit Alpha-2, IL13R, CD213a2 Antigen; NP); IL20Rα; Intestinal carboxyl esterase; IRTA2 (alias of FcRH5); Kallikrein 4 (KLK4, Kallikrein-Related Peptidase 4, PRSS17, EMSP1, Enamel Matrix Serine Proteinase 1, Kallikrein-Like Protein 1, Serine Protease 17, KLK-L1, PSTS, AI2A1, Kallikrein 4 (Prostase, Enamel Matrix, Prostate), ARM1, EMSP, Androgen-Regulated Message 1, Enamel Matrix Serine Protease 1, kallikrein, kallikrein-4, prostase, EC 3.4.21.-, Prostase, EC 3.4.21; GenBank: AAX30051.1); KIF20A (Kinesin Family Member 20A, RAB6KIFL, RAB6 Interacting, Kinesin-Like (Rabkinesin6), Mitotic a; LAGE-1; LDLR-fucosyltransferaseASfusion protein; Lengsin (LGSN, Lengsin, Lens Protein With Glutamine Synthetase Domain, GLULD1, Glutamate-Ammonia Ligase Domain-Containing Protein 1, LGS, Glutamate-Ammonia Ligase (Glutamine Synthetase) Domain Containing 1, Glutamate-Ammonia Ligase (Glutamine Synthase) Domain Containing 1, Lens Glutamine Synthase-Like; GenBank: AAF61255.1); LGR5 (leucine-rich repeat-containing G protein-coupled receptor 5; GPR49, GPR6; NP-003658.1; NM-003667.2; LY64 (Lymphocyte antigen 64 (RP10, type I membrane protein of the leucine rich repeat (LRR) family, regulates B-cell activation and apoptosis, loss of function is associated with increased disease activity in patients with systemic lupus erythematosis); 661 aa, µl: 6.20, MW: 74147 TM: 1 [P] Gene Chromosome: 5q12, Genbank accession No. NP-005573.; Ly6E (lymphocyte antigen 6 complex, locus E; Ly67, RIG-E, SCA-2, TSA-; NP-002337.1; NM-002346.2); Ly6G6D (lymphocyte antigen 6 complex, locus G6D; Ly6-D, MEGT; NP-067079.2; NM-021246.2); LY6K (lymphocyte antigen 6 complex, locus K; LY6K; HSJ001348; FLJ3522; NP-059997.3; NM-017527.3); LyPD1-LY6/PLAUR domain containing 1, PHTS [*Homo sapiens*], GenBank: AAH17318.1); MAGE-A1 (Melanoma Antigen Family A, 1 (Directs Expression Of Antigen MZ2-E, MAGE1, Melanoma Antigen Family A 1, MAGEA1, Melanoma Antigen MAGE-1, Melanoma-Associated Antigen 1, Melanoma-Associated Antigen MZ2-E, Antigen MZ2-E, Cancer/Testis Antigen 1.1, CT1.1, MAGE-1 Antigen, Cancer/Testis Antigen Family 1, Member 1, Cancer/Testis Antigen Family 1, Member 1, MAGE1A; NCBI Reference Sequence: NP-004979.3); MAGE-A10 (MAGEA10, Melanoma Antigen Family A, 10, MAGE10, MAGE-10 Antigen, Melanoma-Associated Antigen 10, Cancer/Testis Antigen 1.10, CT1.10, Cancer/Testis Antigen Family 1, Member 10, Cancer/Testis Antigen Family 1, Member 10; NCBI Reference Sequence: NP-001238757.1); MAGE-A12 (MAGEA12, Melanoma Antigen Family A, 12, MAGE12, Cancer/Testis Antigen 1.12, CT1.12, MAGE12F Antigen, Cancer/Testis Antigen Family 1, Member 12, Cancer/Testis Antigen Family 1, Member 12, Melanoma-Associated Antigen 12, MAGE-12 Antigen; NCBI Reference Sequence: NP-001159859.1); MAGE-A2 (MAGEA2, Melanoma Antigen Family A, 2, MAGE2, Cancer/Testis Antigen 1.2, CT1.2, MAGEA2A, MAGE-2 Antigen, Cancer/Testis Antigen Family 1, Member 2, Cancer/Testis Antigen Family 1, Member 2, Melanoma Antigen 2, Melanoma-Associated Antigen 2; NCBI Reference Sequence: NP-001269434.1); MAGE-A3 (MAGEA3, Melanoma Antigen Family A, 3, MAGE3, MAGE-3 Antigen, Antigen MZ2-D, Melanoma-Associated Antigen 3, Cancer/Testis Antigen 1.3, CT1.3, Cancer/Testis Antigen Family 1, Member 3, HIPS, HYPD, MAGEA6, Cancer/Testis Antigen Family 1, Member 3; NCBI Reference Sequence: NP-005353.1); MAGE-A4 (MAGEA4, Melanoma Antigen Family A, 4, MAGE4, Melanoma-Associated Antigen 4, Cancer/Testis Antigen 1.4, CT1.4, MAGE-4 Antigen, MAGE-41 Antigen, MAGE-X2 Antigen, MAGE4A, MAGE4B, Cancer/Testis Antigen Family 1, Member 4, MAGE-41, MAGE-X2, Cancer/Testis Antigen Family 1, Member 4; NCBI Reference Sequence: NP-001011550.1); MAGE-A6 (MAGEA6, Melanoma Antigen Family A, 6, MAGE6, MAGE-6 Antigen, Melanoma-Associated Antigen 6, Cancer/Testis Antigen 1.6, CT1.6, MAGE3B Antigen, Cancer/Testis Antigen Family 1, Melanoma Antigen Family A 6, Member 6, MAGE-3b, MAGE3B, Cancer/Testis Antigen Family 1, Member 6; NCBI Reference Sequence: NP-787064.1); MAGE-A9 (MAGEA9, Melanoma Antigen Family A, 9, MAGE9, MAGE-9 Antigen, Melanoma-Associated Antigen 9, Cancer/Testis Antigen 1.9, CT1.9, Cancer/Testis Antigen Family 1, Member 9, Cancer/Testis Antigen Family 1, Member 9, MAGEA9A; NCBI Reference Sequence: NP-005356.1); MAGE-C1 (MAGEC1, Melanoma Antigen Family C, 1, Cancer/Testis Antigen 7.1, CT7.1, MAGE-C1 Antigen, Cancer/Testis Antigen Family 7, Member 1, CT7, Cancer/Testis Antigen Family 7, Member 1, Melanoma-Associated Antigen C1; NCBI Reference Sequence: NP-005453.2); MAGE-C2 (MAGEC2, Melanoma Antigen Family C, 2, MAGEE1, Cancer/Testis Antigen 10, CT10, HCA587, Melanoma Antigen, Family E, 1, Cancer/Testis Specific, Hepatocellular Carcinoma-Associated Antigen 587, MAGE-C2 Antigen, MAGE-E1 Antigen, Hepatocellular Cancer Antigen 587, Melanoma-Associated Antigen C2; NCBI Reference Sequence: NP-057333.1); mammaglobin-A (SCGB2A2, Secretoglobin, Family 2A, Member 2, MGB1, Mammaglobin 1, UGB2, Mammaglobin A, mammaglobin-A, Mammaglobin-1, Secretoglobin Family 2A Member 2; NP); MART2 (H HAT, Hedgehog Acyltransferase, SKI1, Melanoma Antigen Recognized By T-Cells 2, Skinny Hedgehog Protein 1, Skn, Melanoma Antigen Recognized By T Cells 2, Protein-Cysteine N-Palmitoyltransferase HHAT, EC 2.3.1.-; GenBank: AAH39071.1); M-CSF (CSF1, Colony Stimulating Factor 1 (Macrophage), MCSF, CSF-1, lanimostim, Macrophage Colony-Stimulating Factor 1, Lanimostim; GenBank: AAH21117.1); MCSP (SMCP, Sperm Mitochondria-Associated Cysteine-Rich Protein, MCS, Mitochondrial Capsule Selenoprotein, HSMCSGEN1, Sperm Mitochondrial-Associated Cysteine-Rich Protein; NCBI Reference Sequence: NP-109588.2); XAGE-1b/GAGED2a; WT1 (Wilms Tumor 1, WAGR, GUD, WIT-2, WT33, Amino-Terminal Domain Of EWS, NPHS4, Last Three Zinc Fingers Of The DNA-Binding Domain Of WT1, AWT 1, Wilms Tumor Protein, EWS-WT1; GenBank: AAB33443.1); VEGF; Tyrosinase (TYR; OCAIA; OCA1A; tyrosinase; SHEP; NP-000363.1; NM-000372.4; GenBank: AAB60319.1); TrpM4 (BR22450, FLJ20041, TRPM4, TRPM4B, transient receptor potential cation channel, subfamily M, member 4, Genbank accession no. NM-01763); TRP2-INT2; TRP-2; TRP-1/gp75 (Tyrosinase-Related Protein 1, 5,6-Dihydroxyindole-2-Carboxylic Acid Oxidase, CAS2, CATB, TYRP, OCAS, Catalase B, b-PROTEIN, Glycoprotein 75, EC 1.14.18, Melanoma Antigen Gp75, TYRP1, TRP, TYRRP, TRP1, SHEP11, DHICA Oxidase, EC 1.14.18, GP75, EC 1.14.18.1; Triosephosphate isomerase (Triosephosphate isomerase 1, TPID, Triose-Phosphate Isomerase, HEL-S-49, TIM, Epididymis Secretory Protein Li 49, TPI, Triosephosphate Isomerase, EC 5.3.1.1; TRAG-3 (CSAG Family Member 2, Cancer/Testis Antigen Family 24, CSAG3B, Member 2, CSAG Family Member 3B, Cancer/Testis Antigen Family 24 Member 2, Cancer/Testis Antigen 24.2, Chondrosarcoma-Associated Gene 2/3 Protein, Taxol-Resistant-Associated Gene 3 Protein, Chondrosarcoma-Associated Gene 2/3 Protein-Like, CT24.2, Taxol Resistance Associated Gene 3, TRAG-3, CSAG3A, TRAG3;); TMEM46 (shisa homolog 2 (*Xenopus laevis*); SHISA; NP-001007539.1; NM-001007538.1; TMEM118 (ring finger protein, transmembrane2; RNFT2; FLJ1462; NP-001103373.1; NM-001109903.1; TMEFF1 (transmembrane protein with EGF-like and two follistatin-like domains 1; Tomoregulin-; H7365; C9orf2; C9ORF2; U19878; X83961; NM-080655; NM-003692; TGF-betaRII (TGFBR2, Transforming Growth Factor, Beta Receptor II (70/80 kDa), TGFbeta-RII, MFS2, tbetaR-II, TGFR-2, TGF-Beta Receptor Type IIB, TGF-Beta Type II Receptor, TGF- Beta Receptor Type-2, EC 2.7.11.30, Transforming Growth Factor Beta Receptor Type IIC, AAT3, TbetaR-II, Transforming Growth Factor, Beta Receptor II (70-80 kD), TGF-Beta Receptor Type II, FAA3, Transforming Growth Factor-Beta Receptor Type II, LDS1 B, HNPCC6, LDS2B, LDS2, RITC, EC 2.7.11, TAAD2; TENB2 (TMEFF2, tomoregulin, TPEF, HPP1, TR, putative transmembrane proteoglycan, related to the EGF/heregulin family of growth factors and follistatin); 374 aa, NCBI Accession: AAD55776, AAF91397, AAG49451, NCBI RefSeq: NP-057276; NCBI Gene: 23671; OMIM: 605734; SwissProt Q9UIK5; Genbank accession No. AF179274; AY358907, CAF85723, CQ782436; TAG-2; TAG-1 (Contactin 2 (Axonal), TAG-1, AXT, Axonin-1 Cell Adhesion Molecule, TAX, Contactin 2 (transiently Expressed), TAXI, Contactin-2, Axonal Glycoprotein TAG-1, Transiently-Expressed Axonal Glycoprotein, Transient Axonal Glycoprotein, Axonin-1, TAX-1, TAG1, FAMES; PRF: 444868); SYT-SSX1 or -SSX2 fusion protein; survivin; STEAP2 (HGNC 8639, IPCA-1, PCANAP1, STAMP1, STEAP2, STMP, prostate cancer associated gene 1, prostate cancer associated protein 1, six transmembrane epithelial antigen of prostate 2, six transmembrane prostate protein, Genbank accession no. AF45513; STEAP1 (six transmembrane epithelial antigen of prostate, Genbank accession no. NM-01244; SSX-4; SSX-2 (SSX2, Synovial Sarcoma, X Breakpoint2, X Breakpoint 2, SSX, X Breakpoint 2B, Cancer/Testis Antigen 5.2, X-Chromosome-Related 2, Tumor Antigen HOM-MEL-40, CT5.2, HD21, Cancer/Testis Antigen Family 5, HOM-MEL-40, Isoform B, Cancer/Testis Antigen Family 5 member 2a, member 2a, Protein SSX2, Sarcoma, Sarcoma, Synovial, X-Chromosome-Related 2, synovial, Synovial Sarcoma, X Breakpoint 2B, Synovial Sarcomam, SSX2A; Sp17; SOX10 (SRY (Sex Determining Region Y)-Box 10, mouse, PCWH, DOM, WS4, WS2E, WS4C, Dominant Megacolon, mouse, Human Homolog Of, Dominant Megacolon, SRY-Related HMG-Box Gene 10, Human Homolog Of, transcription Factor SOX-10; GenBank: CAG30470.1); SNRPD1 (Small Nuclear Ribonucleoprotein D1, Small Nuclear Ribonucleoprotein D1, Polypeptide 16 kDa, Polypeptide (16 kD), SNRPD, HsT2456, Sm-D1, SMD 1, Sm-D Autoantigen, Small Nuclear Ribonucleoprotein D1 Polypeptide 16 kDa Pseudogene, SnRNP Core Protein D1, Small Nuclear Ribonucleoprotein Sm D1; SLC35D3 (Solute Carrier Family 35, Member D3, FRCL1, Fringe Connection-Like Protein 1, bA55K22.3, Frc, Fringe-Like 1, Solute Carrier Family 35 Member D3; NCBI GenBank: NC-000006.11 NC-018917.2 NT-025741.16); SIRT2 (Sirtuin 2, NAD-Dependent Deacetylase Sirtuin-2, SIRL2, Silent Information Regulator 2, Regulatory Protein SIR2 Homolog 2, Sir2-Related Protein Type 2, SIR2-Like Protein 2, Sirtuin Type 2, Sirtuin (Silent Mating Type Information Regulation 2 Homolog) 2 (S. cerevisiae), Sirtuin-2, Sirtuin (Silent Mating Type Information Regulation 2, S. cerevisiae, Homolog) 2, EC 3.5.1, SIR2; GenBank: AAK51133.1); Sema 5b (FLJ10372, KIAA1445, Mm.42015, SEMA5B, SEMAG, Semaphorin 5b Hlog, sema domain, seven thrombospondin repeats (type 1 and type 1-like), Transmembrane Domain™ and short cytoplasmic domain, (semaphorin) 5B, Genbank accession no. AB04087; secernin 1 (SCRN1, SES1, KIAA0193, secerin-1; GenBank: EAL24458.1); SAGE (SAGE1, Sarcoma Antigen 1, Cancer/Testis Antigen 14, CT14, Putative Tumor Antigen; NCBI Reference Sequence: NP-061136.2); RU2AS (KAAG1, Kidney Associated Antigen 1, RU2AS, RU2 Antisense Gene Protein, Kidney-Associated Antigen 1; GenBank: AAF23613.1); RNF43-E3 ubiquitin-protein ligase RNF43 precursor [*Homo sapiens*], RNF124; URCC; NCBI Reference Sequence: NP-060233.3; RhoC (RGS5 (Regulator Of G-Protein Signaling 5, MSTP032, Regulator Of G-Protein Signalling 5, MSTP092, MSTP092, MSTP106, MST106, MSTP129, MST129; GenBank: AAB84001.1); RET (ret proto-oncogene; MEN2A; HSCR1; MEN2B; MTC1; PTC; CDHF12; Hs.168114; RET51; RET-ELE; NP-066124.1; NM-020975.4); RBAF600 (UBR4, Ubiquitin Protein Ligase E3 Component N-Recognin 4, Zinc Finger, UBR1 Type 1, ZUBR1, E3 Ubiquitin-Protein Ligase UBR4, RBAF600, 600 KDa Retinoblastoma Protein-Associated Factor, Zinc Finger UBR1-Type Protein 1, EC 6.3.2, N-recognin-4, KIAA0462, p600, EC 6.3.2, KIAA1307; GenBank: AAL83880.1); RAGE-1 (MOK, MOK Protein Kinase, Renal Tumor Antigen, RAGE, MAPK/MAK/MRK Overlapping Kinase, Renal Tumor Antigen 1, Renal Cell Carcinoma Antigen, RAGE-1, EC 2.7.11.22, RAGE1; UniProtKB/Swiss-Prot: Q9UQ07.1); RAB38/NY-MEL-1 (RAB38, NY-MEL-1, RAB38, Member RAS Oncogene Family, Melanoma Antigen NY-MEL-1, Rab-Related GTP-Binding Protein, Ras-Related Protein Rab-38, rrGTPbp; GenBank: AAH15808.1); PTPRK (DJ480J14.2.1 (Protein Tyrosine Phosphatase, Receptor Type, K R-PTP-KAPPA, Protein Tyrosine Phosphatase Kappa, Protein Tyrosine Phosphatase Kappa), Protein Tyrosine Phosphatase, Receptor Type, K, Protein-Tyrosine Phosphatase Kappa, Protein-Tyrosine Phosphatase, Receptor Type, Kappa, R-PTP-kappa, Receptor-Type Tyrosine-Protein Phosphatase Kappa, EC 3.1.3.48, PTPK; GenBank: AAI44514.1); PSMA; PSCA hIg (2700050C12Rik, C530008016Rik, RIKEN cDNA 2700050C12, RIKEN cDNA 2700050C12 gene, Genbank accession no. AY358628); PSCA (Prostate stem cell antigen precursor, Genbank accession no. AJ29743; PRDX5 (Peroxiredoxin 5, EC 1.11.1.15, TPx Type VI, B166, Antioxidant Enzyme B166, HEL-S-55, Liver Tissue 2D-Page Spot 71 B, PMP20, Peroxisomal Antioxidant Enzyme, PRDX6, Thioredoxin Peroxidase PMP20, PRXV, AOEB 166, Epididymis Secretory Protein Li 55, Alu Co-Repressor 1, Peroxiredoxin-5, Mitochondrial, Peroxiredoxin V, prx-V, Thioredoxin Reductase, Prx-V, ACR1, Alu Corepressor, PLP; GenBank: CAG33484.1); PRAME (Preferentially Expressed Antigen In Melanoma, Preferentially Expressed Antigen Of Melanoma, MAPE, 01P-4, OIPA, CT130, Cancer/Testis Antigen 130, Melanoma Antigen Preferentially Expressed In Tumors, Opa-Interacting Protein 4, Opa-Interacting Protein 01P4; GenBank: CAG30435.1); pml-RARalpha fusion protein; PMEL17 (silver homolog; SILV; D12S53E; PMEL17; SI; SIL); ME20; gp10 BC001414; BT007202; M32295; M77348; NM-006928; PBF (ZNF395, Zinc Finger Protein 395, PRF-1, Huntington disease regulatory, HD Gene Regulatory Region-Binding Protein, Region-Binding Protein 2, Protein 2, Papillomavirus Regulatory Factor 1, HD-Regulating Factor 2, Papillomavirus-Regulatory Factor, PRF1, HDBP-2, Si-1-8-14, HDBP2, Huntington'S Disease Gene Regulatory Region-Binding Protein 2, HDRF-2, Papillomavirus Regulatory Factor PRF-1, PBF; GenBank: AAH01237.1); PAX5 (Paired Box 5, Paired Box Homeotic Gene 5, BSAP, Paired Box Protein Pax-5, B-Cell Lineage Specific Activator, Paired Domain Gene 5, Paired Box Gene 5 (B-Cell Lineage Specific Activator Protein), B-Cell-Specific Transcription Factor, Paired Box Gene 5 (B-Cell Lineage Specific Activator); PAP (REG3A, Regenerating Islet-Derived 3 Alpha, INGAP, PAP-H, Hepatointestinal Pancreatic Protein, PBBCGF, Human Proislet Peptide, REG-Ill, Pancreatitis-Associated Protein 1, Regi, Reg III-Alpha, hepatocarcinoma-intestine-pancreas, Regenerating Islet-Derived Protein III-Alpha, Pancreatic Beta Cell Growth Factor, HIP, PAP Homologous Protein, HIP/PAP, Proliferation-Inducing Protein 34, PAP1, Proliferation-Inducing Protein 42, REG-3-alpha, Regenerating Islet-Derived Protein 3-Alpha, Pancreatitis-Associated Protein; GenBank: AAH36776.1); p53 (TP53, Tumor Protein P53, TPR53, P53, Cellular Tumor Antigen P53, Antigen NY-CO-13, Mutant Tumor Protein 53, Phosphoprotein P53, P53 Tumor Suppressor, BCC7, Transformation-Related Protein 53, LFS1, tumor Protein 53, Li-Fraumeni Syndrome, Tumor Suppressor P53; P2X5 (Purinergic receptor P2X ligand-gated ion channel 5, an ion channel gated by extracellular ATP, may be involved in synaptic transmission and neurogenesis, deficiency may contribute to the pathophysiology of idiopathic detrusor instability); 422 aa), al: 7.63, MW: 47206 TM: 1 [P] Gene Chromosome: 17p13.3, Genbank accession No. NP-002552.; OGT (0-Linked N-Acetylglucosamine (GlcNAc) Transferase, O-GlcNAc Transferase P110 Subunit, 0-Linked N-Acetylglucosamine (GlcNAc) Transferase (UDP-N-Acetylglucosamine:Polypeptide-N-Acetylglucosaminyl Transferase, UDP-N-Acetylglucosamine-Peptide N-Acetylglucosaminyltransferase 110 KDa Subunit, UDP-N-Acetylglucosamine:Polypeptide-N-Acetylglucosaminyl Transferase, Uridinediphospho-N-Acetylglucosamine:Polypeptide Beta-N-Acetylglucosaminyl Transferase, O-GlcNAc Transferase Subunit P110, EC 2.4.1.255, 0-Linked N-Acetylglucosamine Transferase 110 KDa Subunit, EC 2.4.1, HRNT1, EC 2.4.1.186, 0-GLCNAC; GenBank: AAH38180.1); 0A1 (Osteoarthritis QTL 1, OASD; GenBank: CAA88742.1); NY-ESO-1/LAGE-2 (Cancer/Testis Antigen 1 B, CTAG1 B, NY-ESO-1, LAGE-2, ESO1, CTAG1, CTAG, LAGE2B, Cancer/Testis Antigen 1, Autoimmunogenic Cancer/Testis Antigen NY-ESO-1, Ancer Antigen 3, Cancer/Testis Antigen 6.1, New York Esophageal Squamous Cell Carcinoma 1, L Antigen Family Member 2, LAGE2, CT6.1, LAGE2A; GenBank: AAI30365.1); NY-BR-1 (ANKRD30A, Ankyrin Repeat Domain 30A, Breast Cancer Antigen NY-BR-1, Serologically Defined Breast Cancer Antigen NY-BR-1, Ankyrin Repeat Domain-Containing Protein 30A; NCBI Reference Sequence: NP-443723.2); N-ras (NRAS, Neuroblastoma RAS Viral (V-Ras) Oncogene Homolog, NRAS 1, Transforming Protein N-Ras, GTPase NRas, ALPS4, N-Ras Protein Part 4, NS6, Oncogene Homolog, HRAS1; GenBank: AAH05219.1); NFYC (Nuclear Transcription Factor Y, Gamma, HAP5, HSM, Nuclear Transcription Factor Y Subunit C, Transactivator HSM-1/2, CCAAT Binding Factor Subunit C, NF-YC, CCAAT Transcription Binding Factor Subunit Gamma, CAAT Box DNA-Binding Protein Subunit C, Histone H1 Transcription Factor Large Subunit 2A, CBFC, Nuclear Transcription Factor Y Subunit Gamma, CBF-C, Transactivator HSM-1, H1TF2A, Transcription Factor NF-Y, C Subunit; neo-PAP (PAPOLG, Poly(A) Polymerase Gamma, Neo-Poly(A) Polymerase, Nuclear Poly(A) Polymerase Gamma, Polynucleotide Adenylyltransferase Gamma, SRP RNA 3' Adenylating Enzyme/Pap2, PAP-gamma, Neo-PAP, SRP RNA 3'-Adenylating Enzyme, PAP2, EC 2.7.7.19, PAPG; NCBI Reference Sequence: NP-075045.2); NCA (CEACAM6, Genbank accession no. M1872); Napi3b (NAPI-3B, NPTIIb, SLC34A2, solute carrier family 34 (sodium phosphate), member 2, type II sodium-dependent phosphate transporter 3b, Genbank accession no. NM-00642); Myosin class I; MUM-3; MUM-2 (TRAPPC1, Trafficking Protein Particle Complex 1, BETS, BETS Homolog, MUM2, Melanoma Ubiquitous Mutated 2, Multiple Myeloma Protein 2, Trafficking Protein Particle Complex Subunit 1; MUM-lf; Mucin (MUC1, Mucin 1, Cell Surface Associated, PEMT, PUM, CA 15-3, MCKD1, ADMCKD, Medullary Cystic Kidney Disease 1 (Autosomal Dominant), ADMCKD1, Mucin 1, Transmembrane, CD227, Breast Carcinoma-Associated Antigen DF3, MAM6, Cancer Antigen 15-3, MCD, Carcinoma-Associated Mucin, MCKD, Krebs Von Den Lungen-6, MUC-1/SEC, Peanut-Reactive Urinary Mucin, MUC1/ZD, Tumor-Associated Epithelial Membrane Antigen, DF3 Antigen, Tumor-Associated Mucin, episialin, EMA, H23 Antigen, H23AG, Mucin-1, KL-6, Tumor Associated Epithelial Mucin, MUC-1, Episialin, PEM, CD227 Antigen; UniProtKB/Swiss-Prot: P15941.3); MUCSAC (Mucin SAC, Oligomeric Mucus/Gel-Forming, Tracheobronchial Mucin' MUC5, TBM, Mucin 5, Subtypes A And C, Tracheobronchial/Gastric, leB, Gastric Mucin, Mucin SAC, Oligomeric Mucus/Gel-Forming Pseudogene, Lewis B Blood Group Antigen, LeB, Major Airway Glycoprotein, MUC-SAC, Mucin-5 Subtype AC, Tracheobronchial; MUC1 (Mucin 1, Cell Surface Associated, PEMT, PUM, CA 15-3, MCKD1, ADMCKD, Medullary Cystic Kidney Disease 1 (Autosomal Dominant), ADMCKD1, Mucin 1, Transmembrane, CD227, Breast Carcinoma-Associated Antigen DF3, MAM6, Cancer Antigen 15-3, MCD, Carcinoma-Associated Mucin, MCKD, Krebs Von Den Lungen-6, MUC-1/SEC, Peanut-Reactive Urinary Mucin, MUC-1/X, Polymorphic Epithelial Mucin, MUC1/ZD, Tumor-Associated Epithelial Membrane Antigen, DF3 Antigen, Tumor-Associated Mucin, episialin, EMA, h23 Antigen, H23AG, mucin-1, KL-6, Tumor Associated Epithelial Mucin, MUC-1, Episialin, PEM, CD227 Antigen; MSG783 (RNF124, hypothetical protein FLJ20315, Genbank accession no. NM-01776; MRP4-multidrug resistance-associated protein 4 isoform 3, MOAT-B; MOATB [Homo sapiens]; NCBI Reference Sequence: NP-001288758.1; MPF (MPF, MSLN, SMR, megakaryocyte potentiating factor, mesothelin, Genbank accession no. NM-00582; MMP-7 (MMP7, matrilysin, MPSL1, matrin, Matrix Metalloproteinase 7 (Matrilysin, Uterine), Uterine Matrilysin, Matrix Metalloproteinase-7, EC 3.4.24.23, Pump-1 Protease, Matrin, Uterine Metalloproteinase, PUMP1, MMP-7, EC 3.4.24, PUMP-1; GenBank: AAC37543.1); MMP-2 (MMP2, Matrix Metallopeptidase 2 (Gelatinase A, 72 kDa Gelatinase, 72 kDa Type IV Collagenase), MONA, CLG4A, Matrix Metalloproteinase 2 (Gelatinase A, 72 kD Gelatinase, 72 kD Type IV Collagenase), CLG4, 72 kDa Gelatinase, 72 kDa Type IV Collagenase), Matrix Metalloproteinase-2, MMP-II, 72 KDa Gelatinase, Collagenase Type IV-A, MMP-2, Matrix Metalloproteinase-II, TBE-1, Neutrophil Gelatinase, EC 3.4.24.24, EC 3.4.24; GenBank: AAH02576.1); and Meloe.

In certain embodiments, the inventive CD3 binding domains and antibodies comprising them comprise a multispecific antibody, for example, a bispecific antibody wherein the multispecific antibody comprises a second binding domain having specificity for a second antigen selected from the group consisting of: 17-IA, 4-1BB, 4Dc, 6-keto-PGF1a, 8-iso-PGF2a, 8-oxo-dG, A1 Adenosine Receptor, A33, ACE, ACE-2, Activin, Activin A, Activin AB, Activin B, Activin C, Activin RIA, Activin RIA ALK-2, Activin RIB ALK-4, Activin RIIA, Activin RUB, ADAM, ADAM10, ADAM12, ADAM15, ADAM17/TACE, ADAM8, ADAM9, ADAMTS, ADAMTS4, ADAMTS5, Addressins, aFGF, ALCAM, ALK, ALK-1, ALK-7, alpha-1-antitrypsin, alpha-V/beta-1 antagonist, ANG, Ang, APAF-1, APE, APJ, APP, APRIL, AR, ARC, ART, Artemin, anti-Id, ASPARTIC, Atrial natriuretic factor, av/b3 integrin, Axl, b2M, B7-1, B7-2, B7-H, B-lymphocyte Stimulator (BlyS), BACE, BACE-1, Bad, BAFF, BAFF-R, Bag-1, BAK, Bax, BCA-1, BCAM, Bel, BCMA, BDNF, b-ECGF, bFGF, BID, Bik, BIM, BLC, BL-CAM, BLK, BMP, BMP-2 BMP-2a, BMP-3

Osteogenin, BMP-4 BMP-2b, BMP-5, BMP-6 Vgr-1, BMP-7 (OP-1), BMP-8 (BMP-8a, OP-2), BMPR, BMPR-IA (ALK-3), BMPR-IB (ALK-6), BRK-2, RPK-1, BMPR-II (BRK-3), BMPs, b-NGF, BOK, Bombesin, Bone-derived neurotrophic factor, BPDE, BPDE-DNA, BTC, complement factor 3 (C3), C3a, C4, C5, C5a, CIO, CA125, CAD-8, Calcitonin, cAMP, carcinoembryonic antigen (CEA), carcinoma-associated antigen, Cathepsin A, Cathepsin B, Cathepsin C/DPPI, Cathepsin D, Cathepsin E, Cathepsin H, Cathepsin L, Cathepsin O, Cathepsin S, Cathepsin V, Cathepsin X/Z/P, CBL, CCI, CCK2, CCL, CCL1, CCL11, CCL12, CCL13, CCL 14, CCL15, CCL16, CCL1 7, CCL18, CCL19, CCL2, CCL20, CCL21, CCL22, CCL23, CCL24, CCL25, CCL26, CCL27, CCL28, CCL3, CCL4, CCL5, CCL6, CCL7, CCL8, CCL9/10, CCR, CCR1, CCR10, CCR10, CCR2, CCR3, CCR4, CCR5, CCR6, CCR7, CCR8, CCR9, CD1, CD2, CD4, CD5, CD6, CD7, CD8, CD10, CD11a, CD11b, CD11c, CD13, CD14, CD15, CD16, CD18, CD19, CD20, CD21, CD22, CD23, CD25, CD27L, CD28, CD29, CD30, CD30L, CD32, CD33 (p67 proteins), CD34, CD38, CD40, CD40L, CD44, CD45, CD46, CD49a, CD52, CD54, CD55, CD56, CD61, CD64, CD66e, CD74, CD80 (B7-1), CD89, CD95, CD123, CD137, CD138, CD140a, CD146, CD147, CD148, CD152, CD164, CEACAM5, CFTR, cGMP, CINC, *Clostridium botulinum* toxin, *Clostridium perfringens* toxin, CKb8-1, CLC, CMV, CMV UL, CNTF, CNTN-1, COX, C-Ret, CRG-2, CT-1, CTACK, CTGF, CTLA-4, CX3CL1, CX3CR1, CXCL, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCR, CXCR1, CXCR2, CXCR3, CXCR4, CXCR5, CXCR6, cytokeratin tumor-associated antigen, DAN, DCC, DcR3, DC-SIGN, Decay accelerating factor, des(1-3)-IGF-I (brain IGF-1), Dhh, digoxin, DNAM-1, Dnase, Dpp, DPPIV/CD26, Dtk, ECAD, EDA, EDA-A1, EDA-A2, EDAR, EGF, EGFR (ErbB-1), EMA, EMMPRIN, EN A, endothelin receptor, Enkephalinase, eNOS, Eot, eotaxin1, EpCAM, Ephrin B2/EphB4, EPO, ERCC, E-selectin, ET-1, Factor IIa, Factor VII, Factor VIIIc, Factor IX, fibroblast activation protein (FAP), Fas, FcRI, FEN-1, Ferritin, FGF, FGF-19, FGF-2, FGF3, FGF-8, FGFR, FGFR-3, Fibrin, FL, FLIP, Flt-3, Flt-4, Follicle stimulating hormone, Fractalkine, FZD1, FZD2, FZD3, FZD4, FZD5, FZD6, FZD7, FZD8, FZD9, FZD10, G250, Gas 6, GCP-2, GCSF, GD2, GD3, GDF, GDF-1, GDF-3 (Vgr-2), GDF-5 (BMP-14, CDMP-1), GDF-6 (BMP-13, CDMP-2), GDF-7 (BMP-12, CDMP-3), GDF-8 (Myostatin), GDF-9, GDF-15 (MIC-1), GDNF, GDNF, GFAP, GFRa-1, GFR-alpha1, GFR-alpha2, GFR-alpha3, GITR, Glucagon, Glut 4, glycoprotein IIb/IIIa (GP IIb/IIIa), GM-CSF, gp130, gp72, GRO, Growth hormone releasing factor, Hapten (NP-cap or NIP-cap), HB-EGF, HCC, HCMV gB envelope glycoprotein, HCMV) gH envelope glycoprotein, HCMV UL, Hemopoietic growth factor (HGF), Hep B gpl20, heparanase, Her2, Her2/neu (ErbB-2), Her3 (ErbB-3), Her4 (ErbB-4), herpes simplex virus (HSV) gB glycoprotein, HSV gD glycoprotein, HGFA, High molecular weight melanoma-associated antigen (HMW-MAA), HIV gpl20, HIV IIIB gp 120 V3 loop, HLA, HLA-DR, HM1.24, HMFG PEM, HRG, Hrk, human cardiac myosin, human cytomegalovirus (HCMV), human growth hormone (HGH), HVEM, 1-309, IAP, ICAM, ICAM-1, ICAM-3, ICE, ICOS, IFNg, Ig, IgA receptor, IgE, IGF, IGF binding proteins, IGF-1R, IGFBP, IGF-I, IGF-II, IL, IL-1, IL-1R, IL-2, IL-2R, IL-4, IL-4R, IL-5, IL-5R, IL-6, IL-6R, IL-8, IL-9, IL-10, IL-12, IL-13, IL-15, IL-18, IL-18R, IL-23, interferon (INF)-alpha, INF-beta, INF-gamma, Inhibin, iNOS, Insulin A-chain, Insulin B-chain, Insulin-like growth factor 1, integrin alpha2, integrin alpha3, integrin alpha4, integrin alpha4/beta1, integrin, alpha4/beta7, integrin alpha5 (alphaV), integrin alpha5/beta1, integrin alpha5/beta3, integrin alpha6, integrin beta1, integrin beta2, interferon gamma, IP-10, 1-TAC, JE, Kallikrein 2, Kallikrein 5, Kallikrein 6, Kallikrein 11, Kallikrein 12, Kallikrein 14, Kallikrein 15, Kallikrein LI, Kallikrein L2, Kallikrein L3, Kallikrein L4, KC, KDR, Keratinocyte Growth Factor (KGF), laminin 5, LAMP, LAP, LAP (TGF-1), Latent TGF-1, Latent TGF-1 bpl, LBP, LDGF, LECT2, Lefty, Lewis-Y antigen, Lewis-Y related antigen, LFA-1, LFA-3, Lfo, LIF, LIGHT, lipoproteins, LIX, LKN, Lptn, L-Selectin, LT-a, LT-b, LTB4, LTBP-1, Lung surfactant, Luteinizing hormone, Lymphotoxin Beta Receptor, Mac-1, MAdCAM, MAG, MAP2, MARC, MCAM, MCAM, MCK-2, MCP, M-CSF, MDC, Mer, METALLOPROTEASES, MGDF receptor, MGMT, MHC (HLA-DR), MIF, MIG, MIP, MIP-1-alpha, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, MPIF, Mpo, MSK, MSP, mucin (Mucl), MUC18, Muellerian-inhibitin substance, Mug, MuSK, NAIP, NAP, NCAD, N-Cadherin, NCA 90, NCAM, NCAM, Neprilysin, Neurotrophin-3, -4, or -6, Neurturin, Neuronal growth factor (NGF), NGFR, NGF-beta, nNOS, NO, NOS, Npn, NRG-3, NT, NTN, OB, OGG1, OPG, OPN, OSM, OX40L, OX40R, p150, p95, PADPr, Parathyroid hormone, PARC, PARP, PBR, PBSF, PCAD, P-Cadherin, PCNA, PDGF, PDGF, PDK-1, PECAM, PEM, PF4, PGE, PGF, PGI2, PGJ2, PIN, PLA2, placental alkaline phosphatase (PLAP), P1GF, PLP, PP14, Proinsulin, Prorelaxin, Protein C, PS, PSA, PSCA, prostate specific membrane antigen (PSMA), PTEN, PTHrp, Ptk, PTN, R51, RANK, RANKL, RANTES, RANTES, Relaxin A-chain, Relaxin B-chain, renin, respiratory syncytial virus (RSV) F, RSV Fgp, Ret, Rheumatoid factors, RLIP76, RPA2, RSK, S100, SCF/KL, SDF-1, SERINE, Serum albumin, sFRP-3, Shh, SIGIRR, SK-1, SLAM, SLPI, SMAC, SMDF, SMOH, SOD, SPARC, Stat, STEAP, STEAP-II, TACE, TACI, TAG-72 (tumor-associated glycoprotein-72), TARC, TCA-3, T-cell receptors (e.g., T-cell receptor alpha/beta), TdT, TECK, TEM1, TEM5, TEM7, TEM8, TERT, testicular PLAP-like alkaline phosphatase, TfR, TGF, TGF-alpha, TGF-beta, TGF-beta Pan Specific, TGF-beta RI (ALK-5), TGF-beta RII, TGF-beta Rllb, TGF-beta RIII, TGF-beta1, TGF-beta2, TGF-beta3, TGF-beta4, TGF-beta5, Thrombin, Thymus Ck-1, Thyroid stimulating hormone, Tie, TIMP, TIQ, Tissue Factor, TMEFF2, Tmpo, TMPRSS2, TNF, TNF-alpha, TNF-alpha beta, TNF-beta2, TNFc, TNF-RI, TNF-RII, TNFRSF10A (TRAIL R1 Apo-2, DR4), TNFRSFIOB (TRAIL R2 DR5, KILLER, TRICK-2A, TRICK-B), TNFRSF10C (TRAIL R3 DcR1, LIT, TRID), TNFRSF10D (TRAIL R4 DcR2, TRUNDD), TNFRSF11A (RANK ODF R, TRANCE R), TNFRSF11B (OPG OCIF, TR1), TNFRSF12 (TWEAK R FN14), TNFRSF13B (TACI), TNFRSF13C (BAFF R), TNFRSF14 (HVEM ATAR, HveA, LIGHT R, TR2), TNFRSF16 (NGFR p75NTR), TNFRSF17 (BCMA), TNFRSF18 (GITR AITR), TNFRSF19 (TROY TAJ, TRADE), TNFRSF19L (RELT), TNFRSFIA (TNF RI CD120a, p55-60), TNFRSFIB (TNF RII CD120b, p75-80), TNFRSF26 (TNFRH3), TNFRSF3 (LTbR TNF RIII, TNFC R), TNFRSF4 (OX40 ACT35, TXGP1 R), TNFRSF5 (CD40 p50), TNFRSF6 (Fas Apo-1, APT1, CD95), TNFRSF6B (DcR3 M68, TR6), TNFRSF7 (CD27), TNFRSF8 (CD30), TNFRSF9 (4-1BB CD137, ILA), TNFRSF21 (DR6), TNFRSF22 (DcTRAIL R2 TNFRH2), TNFRST23 (DcTRAIL RI TNFRH1), TNFRSF25 (DR3 Apo-3, LARD, TR-3, TRAMP, WSL-1), TNFSF10 (TRAIL Apo-2 Ligand, TL2), TNFSF11 (TRANCE/RANK Ligand ODF, OPG Ligand), TNFSF12 (TWEAK Apo-3 Ligand, DR3 Ligand), TNFSF13 (APRIL TALL2), TNFSF13B (BAFF BLYS, TALL1, THANK, TNFSF20), TNFSF14 (LIGHT HVEM Ligand, LTg), TNFSF15 (TL1A/VEGI), TNFSF18 (GITR Ligand AITR Ligand, TL6), TNFSFIA (TNF-α Conectin, DIF, TNFSF2), TNFSF1B (TNF-b LTa, TNFSF1), TNFSF3 (LTb TNFC, p33), TNFSF4 (OX40 Ligand gp34, TXGP1), TNFSF5 (CD40 Ligand CD154, gp39, HIGM1, IMD3, TRAP), TNFSF6 (Fas Ligand Apo-1 Ligand, APT1 Ligand), TNFSF7 (CD27 Ligand CD70), TNFSF8 (CD30 Ligand CD153), TNFSF9 (4-1BB Ligand CD137 Ligand), TP-1, t-PA, Tpo, TRAIL, TRAIL R, TRAIL-R1, TRAIL-R2, TRANCE, transferring receptor, TRF, Trk, TROP-2, TSG, TSLP, tumor-associated antigen CA 125, tumor-associated antigen expressing Lewis Y related carbohydrate, TWEAK, TXB2, Ung, uPAR, uPAR-1, Urokinase, VCAM, VCAM-1, VECAD, VE-Cadherin, VE-cadherin-2, VEFGR-1 (fit-1), VEGF, VEGFR, VEGFR-3 (fit-4), VEGI, VIM, Viral antigens, VLA, VLA-1, VLA-4, VNR integrin, von Willebrands factor, WIF-1, WNT1, WNT2, WNT2B/13, WNT3, WNT3A, WNT4, WNT5A, WNT5B, WNT6, WNT7A, WNT7B, WNT8A, WNT8B, WNT9A, WNT9A, WNT9B, WNT10A, WNT10B, WNT11, WNT16, XCL1, XCL2, XCR1, XCR1, XEDAR, XIAP, XPD, CTLA4 (cytotoxic T lymphocyte antigen-4), PD1 (programmed cell death protein 1), PD-L1 (programmed cell death ligand 1), LAG-3 (lymphocyte activation gene-3), TIM-3 (T cell immunoglobulin and mucin protein-3), receptors for hormones, and growth factors.

In certain embodiments, the inventive CD3 binding domains and antibodies comprising them comprise a multispecific antibody, for example, a bispecific antibody wherein the multispecific antibody comprises a second binding domain having specificity for a second antigen selected from the group consisting of: BCMA, CTLA4 (cytotoxic T lymphocyte antigen-4), PD1 (programmed cell death protein 1), PD-L1 (programmed cell death ligand 1), LAG-3 (lymphocyte activation gene-3), TIM-3, CD20, CD2, CD19, Her2, EGFR, EpCAM, FcyRIIIa (CD16), FcyRIIa (CD32a), FcyRIIb (CD32b), FcyRI (CD64), Toll-like receptors (TLRs), TLR4, TLR9, cytokines, IL-2, IL-5, L-13, L-6, L-17, L-12, IL-23, TNFa, TGFb, cytokine receptors, IL-2R, chemokines, chemokine receptors, growth factors, VEGF, and HGF.

In some embodiments, the invention provides bispecific antibodies having affinity to CD3 and HER2. In some embodiments, the invention provides bispecific antibodies comprising an antibody fragment (e.g., an Fab) of trastuzumab. Exemplary bispecific CD3 antibodies include ADI-29291, ADI-29292, ADI-29293, ADI-29294, ADI-29295, ADI-29297, ADI-29298, ADI-29300, ADI-29301, ADI-29302, ADI-29303, ADI-29304, ADI-29305, and ADI-29306.

In certain embodiments, the inventive CD3 binding domains and antibodies comprising them may be prepared according to a variety of techniques available to the artisan and include, but are not limited to, recombinant co-expression of two immunoglobulin heavy chain-light chain pairs having different specificities (see Milstein and Cuello, Nature 305: 537 (1983)), WO 93/08829, and Traunecker et al., EMBO J. 10: 3655 (1991)), and "knob-in-hole" engineering (see, e.g., U.S. Pat. No. 5,731,168). "Knob-in-hole" engineering of multispecific antibodies may be utilized to generate a first arm containing a knob and a second arm containing the hole into which the knob of the first arm may bind. The knob of the multispecific antibodies of the invention may be an anti-CD3 arm in one embodiment. Alternatively, the knob of the multispecific antibodies of the invention may be an anti-target/antigen arm in one embodiment. The hole of the multispecific antibodies of the invention may be an anti-CD3 arm in one embodiment. Alternatively, the hole of the multispecific antibodies of the invention may be an anti-target/antigen arm in one embodiment. Multispecific antibodies may also be engineered using immunoglobulin crossover (also known as Fab domain exchange or CrossMab format) technology (see e.g., WO2009/080253; Schaefer et al., Proc. Natl. Acad. Sci. USA, 108:11187-11192 (2011)). Multispecific antibodies may also be made by engineering electrostatic steering effects for making antibody Fc-heterodimeric molecules (WO 2009/089004A1); cross-linking two or more antibodies or fragments (see, e.g., U.S. Pat. No. 4,676,980, and Brennan et al., Science, 229: 81 (1985)); using leucine zippers to produce bi-specific antibodies (see, e.g., Kostelny et al., J. Immunol, 148(5):1547-1553 (1992)); using "diabody" technology for making bispecific antibody fragments (see, e.g., Hollinger et al., Proc. Natl. Acad. Sci. USA, 90:6444-6448 (1993)); and using single-chain Fv (sFv) dimers (see, e.g. Gruber et al., J. ImmunoL, 152:5368 (1994)); and preparing trispecific antibodies as described, e.g., in Tutt et al. J. ImmunoL 147: 60 (1991). Additional non-limiting examples of multispecific and bispecific formats that are amenable to incorporation of the inventive anti-CD3 binding domains include, e.g., Fab-Fc-scFv ("bottle-opener") (XENCOR), Mab-scFv (XENCOR), Mab-Fv (XENCOR), Dual scFv (XENCOR), central Fv (XENCOR), central scFv(XENCOR), one-arm central scFv (XENCOR), Fab-Fab (XENCOR), Fab-Fv (XENCOR), mAb-Fv (XENCOR), mAb-Fab (XENCOR), DART (MacroGenics), BiTE (Amgen/Micromet), KiTE, common light chain-IgG (Genentech), TandAb (Affimed) Cross-Mab (Roche), SEED (EMD Serono), BEAT (Glenmark), TrioMab (Trion Pharma/Fresnius Biotech), DuetMab (MedImmune), and others. Methods for preparing such multispecific antibodies are disclosed in, for example: WO 95/09917; WO 2008/119566; WO 2008/119567; WO2011/121110; WO 2010/037835; WO 2007/042261; WO 2007/110205; WO 2011/121110; WO 2012/055961; WO 2012/16067; WO 2016/086189; WO 2016/182751; WO 2015/006749; WO 2014/049003; WO 2013/177101; WO 2015/128509; U.S. Pat. No. 7,951,917; US 2009/0252729; US 2014/0348839; U.S. Pat. No. 7,183,076; Mazor et al., Mabs, Vol. 7, pages 377-389 (2015); Muda et al., Protein Engineering, Designe, & Selection, Vol. 24, pages 447-454 (2011); and Del Bano et al., Antibodies, Vol. 5, pages 1-23 (2016).

Still further exemplary bispecific antibody format that can be used in the context of the present invention involves the use of a first immunoglobulin (Ig) CH3 domain and a second Ig CH3 domain, wherein the first and second Ig CH3 domains differ from one another by at least one amino acid, and wherein at least one amino acid difference reduces binding of the bi-specific antibody to Protein A as compared to a bi-specific antibody lacking the amino acid difference. In one embodiment, the first Ig CH3 domain binds Protein A and the second Ig CH3 domain contains a mutation that reduces or abolishes Protein A binding such as an H95R modification (by IMGT exon numbering; H435R by EU numbering). The second CH3 may further comprise a Y96F modification (by IMGT; Y436F by EU). Further modifications that may be found within the second CH3 include: D16E, L18M, N44S, K52N, V57M, and V82I (by IMGT; D356E, L358M, N384S, K392N, V397M, and V422I by EU) in the case of lgG1 antibodies; N44S, K52N, and V82I (IMGT; N384S, K392N, and V422I by EU) in the case of lgG2 antibodies; and Q15R, N44S, K52N, V57M, R69K, E79Q, and V82I (by IMGT; Q355R, N384S, K392N, V397M, R409K, E419Q, and V422I by EU) in the case of lgG4 antibodies.

In certain embodiments, the inventive CD3 binding domains and antibodies comprising them may be prepared according as engineered antibodies with three or more functional antigen binding sites, including "Octopus antibodies," as disclosed in, e.g. US 2006/0025576A1.

In certain embodiments, the inventive CD3 binding domains and antibodies comprising them may be prepared as a "Dual Acting FAb" or "DAF" comprising an antigen binding site that binds to CD3 as well as another, different antigen as disclosed in e.g., US 2008/0069820.

As disclosed herein and throughout, the inventive CD3 binding domains and antibodies comprising them may comprise monospecific, bispecific, or multispecific antibodies. Multispecific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244. The antibodies of the present invention can be linked to or co-expressed with another functional molecule, e.g., another peptide or protein. For example, an antibody or fragment thereof can be functionally linked (e.g., by chemical coupling, genetic fusion, noncovalent association or otherwise) to one or more other molecular entities, such as another antibody or antibody fragment to produce a bi-specific or a multi-specific antibody with a second binding specificity.

In certain embodiments, amino acid sequence variants of the inventive CD3 binding domains and antibodies comprising them are contemplated. For example, it may be desirable to improve the binding affinity and/or other biological properties of the antibody. Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, for example, antigen-binding. In certain embodiments, such variants having one or more amino acid substitutions are provided. Sites of interest for substitutional mutagenesis include the CDRs and FRs. Amino acid substitutions may be introduced into an antibody of interest and the products screened for a desired activity, for example, retained/improved antigen binding, decreased immunogenicity, or improved ADCC or CDC.

One type of substitutional variant involves substituting one or more hypervariable region residues of a parent antibody (e.g., a humanized or human antibody). Generally, the resulting variant(s) selected for further study will have modifications (e.g., improvements) in certain biological properties (e.g., increased affinity, reduced immunogenicity) relative to the parent antibody and/or will have substantially retained certain biological properties of the parent antibody. An exemplary substitutional variant is an affinity matured antibody, which may be conveniently generated, e.g., using phage display-based affinity maturation techniques. Briefly, one or more CDR residues are mutated and the variant antibodies displayed on phage and screened for a particular biological activity (e.g., binding affinity).

Alterations (e.g., substitutions) may be made in CDRs, e.g., to improve antibody affinity. Such alterations may be made in CDR "hotspots," i.e., residues encoded by codons that undergo mutation at high frequency during the somatic maturation process (see, e.g., Chowdhury, Methods Mol. Biol. 207:179-196 (2008)), and/or residues that contact antigen, with the resulting variant VH or VL being tested for binding affinity. Affinity maturation by constructing and reselecting from secondary libraries has been described, e.g., in Hoogenboom et al. in Methods in Molecular Biology 178:1-37 (O'Brien et al., ed., Human Press, Totowa, N.J., (2001).) In some embodiments of affinity maturation, diversity is introduced into the variable genes chosen for maturation by any of a variety of methods (e.g., error-prone PCR, chain shuffling, or oligonucleotide-directed mutagenesis). A secondary library is then created. The library is then screened to identify any antibody variants with the desired affinity. Another method to introduce diversity involves CDR-directed approaches, in which several CDR residues (e.g., 4-6 residues at a time) are randomized. CDR residues involved in antigen binding may be specifically identified, e.g., using alanine scanning mutagenesis or modeling. CDR-H3 and CDR-L3 in particular are often targeted.

In certain embodiments, substitutions, insertions, or deletions may occur within one or more CDRs of the inventive CD3 binding domains and antibodies comprising them, so long as such alterations do not substantially reduce the ability of the antibody to bind antigen. For example, conservative alterations (e.g., conservative substitutions as provided herein) that do not substantially reduce binding affinity may be made in CDRs. Such alterations may, for example, be outside of antigen contacting residues in the CDRs. In certain embodiments of the variant VH and VL sequences provided above, each CDR either is unaltered, or contains no more than one, two or three amino acid substitutions.

A useful method for identification of residues or regions of an antibody that may be targeted for mutagenesis is called "alanine scanning mutagenesis" as described by Cunningham and Wells (1989) Science, 244:1081-1085. In this method, a residue or group of target residues (e.g., charged residues such as arg, asp, his, lys, and glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antibody complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme (e.g. for ADEPT) or a polypeptide which increases the serum half-life of the antibody.

In certain embodiments, the inventive CD3 binding domains and antibodies comprising them can be altered to increase or decrease the extent to which the antibody is glycosylated. Addition or deletion of glycosylation sites to anti-CD3 antibody of the invention may be conveniently accomplished by altering the amino acid sequence such that one or more glycosylation sites is created or removed.

Where the antibody comprises an Fc region, the carbohydrate attached thereto may be altered. Antibodies produced by mammalian cells typically comprise a branched, biantennary oligosaccharide that is generally attached by an N-linkage to Asn297 of the CH2 domain of the Fc region. See, e.g., Wright et al. TIBTECH 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in an antibody of the invention may be made in order to create antibody variants with certain improved properties.

In certain embodiments, variants of the inventive CD3 binding domains and antibodies comprising them are provided having a carbohydrate structure that lacks fucose attached (directly or indirectly) to an Fc region. For example, the amount of fucose in such antibody may be from 1% to 80%, from 1% to 65%, from 5% to 65% or from 20% to 40%. The amount of fucose is determined by calculating the average amount of fucose within the sugar chain at Asn297, relative to the sum of all glycostructures attached to Asn 297 (e.g. complex, hybrid and high mannose structures) as measured by MALDI-TOF mass spectrometry, as described in WO 2008/077546, for example. Asn297 refers to the asparagine residue located at about position 297 in the Fc region (EU numbering of Fc region residues); however, Asn297 may also be located about ±3 amino acids upstream or downstream of position 297, i.e., between positions 294 and 300, due to minor sequence variations in antibodies. Such fucosylation variants may have improved ADCC function. See, e.g., US Patent Publication Nos. US 2003/0157108 (Presta, L.); US 2004/0093621 (Kyowa Hakko Kogyo Co., Ltd). Examples of publications related to "defucosylated" or "fucose-deficient" antibody variants include: US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; WO2002/031140; Okazaki et al. J. Mol. Biol. 336:1239-1249 (2004); Yamane-Ohnuki et al. Biotech. Bioeng. 87: 614 (2004). Examples of cell lines capable of producing defucosylated antibodies include Lec13 CHO cells deficient in protein fucosylation (Ripka et al. Arch. Biochem. Biophys. 249:533-545 (1986); US Pat Pub No 2003/0157108 A1, Presta, L; and WO 2004/056312 A1, Adams et al., especially at Example 11), and knockout cell lines, such as alpha-1,6-fucosyltransferase gene, FUT8, knockout CHO cells (see, e.g., Yamane-Ohnuki et al. Biotech. Bioeng. 87: 614 (2004); Kanda, Y. et al., Biotechnol. Bioeng., 94(4):680-688 (2006); and WO2003/085107).

Anti-CD3 antibodies variants are further provided with bisected oligosaccharides, for example, in which a biantennary oligosaccharide attached to the Fc region of the antibody is bisected by GlcNAc. Such antibody variants may have reduced fucosylation and/or improved ADCC function. Examples of such antibody variants are described, e.g., in WO 2003/011878 (Jean-Mairet et al.); U.S. Pat. No. 6,602,684 (Umana et al.); and US 2005/0123546 (Umana et al.). Antibody variants with at least one galactose residue in the oligosaccharide attached to the Fc region are also provided. Such antibody variants may have improved CDC function. Such antibody variants are described, e.g., in WO 1997/30087 (Patel et al.); WO 1998/58964 (Raju, S.); and WO 1999/22764 (Raju, S.).

In certain embodiments, one or more amino acid modifications may be introduced into the Fc region of an anti-CD3 antibody of the invention, thereby generating an Fc region variant (see e.g., US 2012/0251531). The Fc region variant may comprise a human Fc region sequence (e.g., a human IgG1, IgG2, IgG3 or IgG4 Fc region) comprising an amino acid modification (e.g., a substitution) at one or more amino acid positions.

In certain embodiments, the invention contemplates an anti-CD3 antibody variant that possesses some but not all effector functions, which make it a desirable candidate for applications in which the half life of the antibody in vivo is important yet certain effector functions (such as complement and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the antibody lacks FcγR binding (hence likely lacking ADCC activity) but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, Annu. Rev. Immunol. 9:457-492 (1991). Non-limiting examples of in vitro assays to assess ADCC activity of a molecule of interest is described in U.S. Pat. No. 5,500,362 (see, e.g. Hellstrom, I. et al. Proc. Nat'l Acad. Sci. USA 83:7059-7063 (1986)) and Hellstrom, I et al., Proc. Nat'l Acad. Sci. USA 82:1499-1502 (1985); U.S. Pat. No. 5,821,337 (see Bruggemann, M. et al., J. Exp. Med. 166:1351-1361 (1987)). Alternatively, non-radioactive assays methods may be employed (see, for example, ACTI™ non-radioactive cytotoxicity assay for flow cytometry (Cell Technology, Inc. Mountain View, Calif.; and CytoTox 96® non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. Proc. Nat'l Acad. Sci. USA 95:652-656 (1998). C1q binding assays may also be carried out to confirm that the antibody is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al. J. ImmunoL Methods 202:163 (1996); Cragg, M. S. et al. Blood. 101:1045-1052 (2003); and Cragg, M. S. and M. J. Glennie Blood. 103:2738-2743 (2004)). FcRn binding and in vivo clearance/half life determinations can also be performed using methods known in the art (see, e.g., Petkova, S. B. et al. Int'l. ImmunoL 18(12):1759-1769 (2006)).

Antibodies with reduced effector function include those with substitution of one or more of Fc region residues 238, 265, 269, 270, 297, 327 and 329 (U.S. Pat. Nos. 6,737,056 and 8,219,149). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. Nos. 7,332,581 and 8,219,149).

In certain embodiments, the proline at position 329 of a wild-type human Fc region in the antibody is substituted with glycine or arginine or an amino acid residue large enough to destroy the proline sandwich within the Fc/Fc gamma receptor interface that is formed between the proline 329 of the Fc and tryptophan residues Trp 87 and Trp 110 of FcgRIII (Sondermann et al.: Nature 406, 267-273 (20 Jul. 2000)). In certain embodiments, the antibody comprises at least one further amino acid substitution. In one embodiment, the further amino acid substitution is S228P, E233P, L234A, L235A, L235E, N297A, N297D, or P331S, and still in another embodiment the at least one further amino acid substitution is L234A and L235A of the human IgG1 Fc region or S228P and L235E of the human IgG4 Fc region (see e.g., US 2012/0251531), and still in another embodiment the at least one further amino acid substitution is L234A and L235A and P329G of the human IgG1 Fc region.

Certain antibody variants with improved or diminished binding to FcRs are described. (See, e.g., U.S. Pat. No. 6,737,056; WO 2004/056312, and Shields et al., J. Biol. Chem. 9(2): 6591-6604 (2001).)

In certain embodiments, an antibody variant comprises an Fc region with one or more amino acid substitutions which improve ADCC, e.g., substitutions at positions 298, 333, and/or 334 of the Fc region (EU numbering of residues).

In some embodiments, alterations are made in the Fc region that result in altered (i.e., either improved or diminished) C1q binding and/or Complement Dependent Cytotoxicity (CDC), e.g., as described in U.S. Pat. No. 6,194,551, WO 99/51642, and Idusogie et al. J. Immunol. 164: 4178-4184 (2000).

Antibodies with increased half lives and improved binding to the neonatal Fc receptor (FcRn), which is responsible for the transfer of maternal IgGs to the fetus (Guyer et al., J. Immunol. 117:587 (1976) and Kim et al., J. Immunol. 24:249 (1994)), are described in US2005/0014934A1 (Hinton et al.). Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826). See also Duncan & Winter, Nature 322:738-40 (1988); U.S. Pat. Nos. 5,648,260; 5,624,821; and WO 94/29351 concerning other examples of Fc region variants.

In some embodiments, the anti-CD3 antibody (e.g., bispecific anti-CD3 antibody) comprises an Fc region comprising an N297G mutation.

In some embodiments, the anti-CD3 antibody comprising the N297G mutation comprises one or more heavy chain constant domains, wherein the one or more heavy chain constant domains are selected from a first CH1 (CH11) domain, a first CH2 (CH21) domain, a first CH3 (CH31) domain, a second CH1 (CH12) domain, second CH2 (CH22) domain, and a second CH3 (CH32) domain. In some instances, at least one of the one or more heavy chain constant domains is paired with another heavy chain constant domain. In some instances, the CH31 and CH32 domains each comprise a protuberance or cavity, and wherein the protuberance or cavity in the CH31 domain is positionable in the cavity or protuberance, respectively, in the CH32 domain. In some instances, the CH31 and CH32 domains meet at an interface between said protuberance and cavity. In some instances, the CH21 and CH22 domains each comprise a protuberance or cavity, and wherein the protuberance or cavity in the CH21 domain is positionable in the cavity or protuberance, respectively, in the CH22 domain. In other instances, the CH21 and CH22 domains meet at an interface between said protuberance and cavity. In some instances, the anti-CD3 antibody is an IgG1 antibody.

In certain embodiments, it may be desirable to create cysteine engineered antibodies, e.g., "thioMAbs," in which one or more residues of an antibody are substituted with cysteine residues. In particular embodiments, the substituted residues occur at accessible sites of the antibody. By substituting those residues with cysteine, reactive thiol groups are thereby positioned at accessible sites of the antibody and may be used to conjugate the antibody to other moieties, such as drug moieties or linker-drug moieties, to create an immunoconjugate, as described further herein. In certain embodiments, any one or more of the following residues may be substituted with cysteine: V205 (Kabat numbering) of the light chain; A118 (EU numbering) of the heavy chain; and S400 (EU numbering) of the heavy chain Fc region. Cysteine engineered antibodies may be generated as described, for example, in U.S. Pat. No. 7,521,541.

In certain embodiments, the inventive CD3 binding domains and antibodies comprising them may be further modified to contain additional nonproteinaceous moieties that are known in the art and readily available. The moieties suitable for derivatization of the antibody include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, polypropylene glycol homopolymers, polypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer are attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

In another embodiment, conjugates of an antibody and nonproteinaceous moiety that may be selectively heated by exposure to radiation are provided. In one embodiment, the nonproteinaceous moiety is a carbon nanotube (Kam et al., Proc. Natl. Acad. Sci. USA 102: 11600-11605 (2005)). The radiation may be of any wavelength, and includes, but is not limited to, wavelengths that do not harm ordinary cells, but which heat the nonproteinaceous moiety to a temperature at which cells proximal to the antibody-nonproteinaceous moiety are killed.

In certain embodiments, the inventive CD3 binding domains and antibodies comprising them may be produced using recombinant methods and compositions, for example, as described in U.S. Pat. No. 4,816,567. In one embodiment, isolated nucleic acid encoding an anti-CD3 antibody described herein is provided. Such nucleic acid may encode an amino acid sequence comprising the VL and/or an amino acid sequence comprising the VH of the antibody (e.g., the light and/or heavy chains of the antibody). In a further embodiment, one or more vectors (e.g., expression vectors) comprising such nucleic acid are provided. In a further embodiment, a host cell comprising such nucleic acid is provided. In one such embodiment, a host cell comprises (e.g., has been transformed with): (1) a vector comprising a nucleic acid that encodes an amino acid sequence comprising the VL of the antibody and an amino acid sequence comprising the VH of the antibody, or (2) a first vector comprising a nucleic acid that encodes an amino acid sequence comprising the VL of the antibody and a second vector comprising a nucleic acid that encodes an amino acid sequence comprising the VH of the antibody. In one embodiment, the host cell is eukaryotic, e.g. a Chinese Hamster Ovary (CHO) cell or lymphoid cell (e.g., Y0, NS0, Sp20 cell). In one embodiment, a method of making an anti-CD3 antibody is provided, wherein the method comprises culturing a host cell comprising a nucleic acid encoding the antibody, as provided above, under conditions suitable for expression of the antibody, and optionally recovering the antibody from the host cell (or host cell culture medium).

For recombinant production of an anti-CD3 antibody, nucleic acid encoding an antibody, e.g., as described above, is isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the heavy and light chains of the antibody).

Suitable host cells for cloning or expression of antibody-encoding vectors include prokaryotic or eukaryotic cells described herein. For example, antibodies may be produced in bacteria, in particular when glycosylation and Fc effector function are not needed. For expression of antibody fragments and polypeptides in bacteria, see, e.g., U.S. Pat. Nos. 5,648,237, 5,789,199, and 5,840,523. (See also Charlton, Methods in Molecular Biology, Vol. 248 (B. K. C. Lo, ed., Humana Press, Totowa, N.J., 2003), pp. 245-254, describing expression of antibody fragments in *E. coli*.) After expression, the antibody may be isolated from the bacterial cell paste in a soluble fraction and can be further purified.

In addition to prokaryotes, eukaryotic microbes such as filamentous fungi or yeast are suitable cloning or expression hosts for antibody-encoding vectors, including fungi and yeast strains whose glycosylation pathways have been "humanized," resulting in the production of an antibody with a partially or fully human glycosylation pattern. See, e.g., Gerngross, Nat. Biotech. 22:1409-1414 (2004), and Li et al., Nat. Biotech. 24:210-215 (2006); WO 2009/036379; WO 2010/105256; and WO 2012/009568.

Suitable host cells for the expression of glycosylated antibody are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells.

Plant cell cultures can also be utilized as hosts. See, e.g., U.S. Pat. Nos. 5,959,177, 6,040,498, 6,420,548, 7,125,978, and 6,417,429 (describing PLANTIBODIES™ technology for producing antibodies in transgenic plants).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., J. Gen Virol. 36:59 (1977)); baby hamster kidney cells (BHK); mouse sertoli cells (TM4 cells as described, e.g., in Mather, Biol. Reprod. 23:243-251 (1980)); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells, as described, e.g., in Mather et al., Annals N.Y. Acad. Sci. 383:44-68 (1982); MRC 5 cells; and FS4 cells. Other useful mammalian host cell lines include Chinese hamster ovary (CHO) cells, including DHFR-CHO cells (Urlaub et al., Proc. Natl. Acad. Sci. USA 77:4216 (1980)); and myeloma cell lines such as Y0, NS0 and Sp2/0. For a review of certain mammalian host cell lines suitable for antibody production, see, e.g., Yazaki and Wu, Methods in Molecular Biology, Vol. 248 (B. K. C. Lo, ed., Humana Press, Totowa, N.J.), pp. 255-268 (2003).

In certain embodiments, the inventive CD3 binding domains and antibodies comprising them may be identified, screened for, selected for or characterized for their physical/chemical properties and/or biological activities by various assays known in the art.

In one aspect, an anti-CD3 antibody of the invention is tested for its antigen binding activity, for example, by known methods such as ELISA, Western blot, etc.

In another aspect, competition assays may be used to identify an antibody that competes with an anti-CD3 antibody of the invention for binding to CD3.

In an exemplary competition assay, immobilized CD3 is incubated in a solution comprising a first labeled antibody that binds to CD3 and a second unlabeled antibody that is being tested for its ability to compete with the first antibody for binding to CD3. The second antibody may be present in a hybridoma supernatant. As a control, immobilized CD3 is incubated in a solution comprising the first labeled antibody but not the second unlabeled antibody. After incubation under conditions permissive for binding of the first antibody to CD3, excess unbound antibody is removed, and the amount of label associated with immobilized CD3 is measured. If the amount of label associated with immobilized CD3 is substantially reduced in the test sample relative to the control sample, then that indicates that the second antibody is competing with the first antibody for binding to CD3. See, e.g., Harlow and Lane (1988) Antibodies: A Laboratory Manual. Ch. 14 (Cold Spring Harbor Laboratory, Cold Spring Harbor, N.Y.).

In one aspect, assays are provided for identifying anti-CD3 antibodies thereof having biological activity. Biological activity may include, for example, binding to CD3 (e.g., CD3 on the surface of a T cell), or a peptide fragment thereof, either in vivo, in vitro, or ex vivo. In the case of a multispecific (e.g., bispecific) anti-CD3 antibody of the invention (e.g., a T-cell Dependent Bispecific Antibody (TDB) having one anti-CD3 arm and one arm that recognizes a second biological molecule, e.g., a cell surface antigen, e.g., a tumor antigen), biological activity may also include, for example, effector cell activation (e.g., T cell (e.g., CD8+ and/or CD4+ T cell) activation), effector cell population expansion (i.e., an increase in T cell count), target cell population reduction (i.e., a decrease in the population of cells expressing the second biological molecule on their cell surfaces), and/or target cell killing. Antibodies having such biological activity in vivo and/or in vitro are provided. In certain embodiments, an antibody of the invention is tested for such biological activity, as described in detail in the Examples herein below.

In some embodiments, the activity comprises ability to support B cell killing and/or the activation of the cytotoxic T cells. In certain embodiments, an anti-B cell targeting anti-CD3 antibody of the invention is tested for such B cell killing and/or the activation of the cytotoxic effect of T cells biological activity by any of the methods described herein, in particular the Examples. In some embodiments of any of these activity assays, PBMCs may be isolated from whole blood of healthy donors by Ficoll separation. In particular, human blood may be collected in heparinized syringes, and PBMCs isolated using Leucosep and Ficoll Paque Plus. If needed CD4+ T and CD8+ T cells may be separated with Miltenyi kits according to manufacturer's instructions.

Further, cells may be washed in RPMI medium containing 10% FBS, supplemented with GlutaMax, penicillin & streptomycin, and ~0.2 million suspended cells added to a 96-well U-bottom plate. Cells may be cultured in RPMI1640 supplemented with 10% FBS at 37° C. in a humidified standard cell culture incubator. For BJAB cell killing assays, 20,000 BJAB cells may be incubated with effector cells, either as huPBMCs or purified T cells, as indicated ratios per assay, in the presence of various concentrations of TDB antibodies for 24 hours. For endogenous B cell killing assays, 200,000 huPBMCs may be incubated with various concentrations of TDB antibodies for 24 hours.

After culturing, cells may be washed with FACS buffer (0.5% BSA, 0.05% Na Azide in PBS). Cells may then be stained in FACS buffer, washed with FACS buffer and suspended in FACS buffer containing 1 μg/ml Propidium Iodide. Data may be collected on a FACSCalibur flow cytometer and analyzed using FlowJo. Live B cells may be gated out as PI-CD19+ or PI-CD20+B cells by FACS, and absolute cell count may be obtained with FITC beads added to reaction mix as an internal counting control. The percent (%) of cell killing may be calculated based on non-TDB treated controls. Activated T cells may be detected by CD69 and CD25 surface expression using anti-CD69-FITC and anti-CD25-PE.

The invention also provides immunoconjugates comprising an inventive CD3 binding domain or an antibody comprising it. An anti-CD3 antibody herein conjugated to one or more cytotoxic agents, such as chemotherapeutic agents or drugs, growth inhibitory agents, toxins (e.g., protein toxins, enzymatically active toxins of bacterial, fungal, plant, or animal origin, or fragments thereof), or radioactive isotopes.

In some embodiments, an immunoconjugate is an antibody-drug conjugate (ADC) in which an antibody is conjugated to one or more drugs, including but not limited to a maytansinoid (see U.S. Pat. Nos. 5,208,020, 5,416,064 and European Patent EP 0 425 235 B1); an auristatin such as monomethylauristatin drug moieties DE and DF (MMAE and MMAF) (see U.S. Pat. Nos. 5,635,483 and 5,780,588, and 7,498,298); a dolastatin; a calicheamicin or derivative thereof (see U.S. Pat. Nos. 5,712,374, 5,714,586, 5,739,116, 5,767,285, 5,770,701, 5,770,710, 5,773,001, and 5,877,296; Hinman et al., Cancer Res. 53:3336-3342 (1993); and Lode et al., Cancer Res. 58:2925-2928 (1998)); an anthracycline such as daunomycin or doxorubicin (see Kratz et al., Current Med. Chem. 13:477-523 (2006); Jeffrey et al., Bioorganic & Med. Chem. Letters 16:358-362 (2006); Torgov et al., Bioconj. Chem. 16:717-721 (2005); Nagy et al., Proc. Natl. Acad. Sci. USA 97:829-834 (2000); Dubowchik et al., Bioorg. & Med. Chem. Letters 12:1529-1532 (2002); King et al., J. Med. Chem. 45:4336-4343 (2002); and U.S. Pat. No. 6,630,579); methotrexate; vindesine; a taxane such as docetaxel, paclitaxel, larotaxel, tesetaxel, and ortataxel; a trichothecene; and CC1065.

In some embodiments, an immunoconjugate comprises an anti-CD3 antibody as described herein conjugated to an enzymatically active toxin or fragment thereof, including but not limited to diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes.

In some embodiments, an immunoconjugate comprises an anti-CD3 antibody as described herein conjugated to a radioactive atom to form a radioconjugate. A variety of radioactive isotopes are available for the production of radioconjugates. Examples include At211, I131, I125, Y90, Re186, Re188, Sm153, Bi212, P32, Pb212 and radioactive isotopes of Lu. When the radioconjugate is used for detection, it may comprise a radioactive atom for scintigraphic studies, for example tc99m or I123, or a spin label for nuclear magnetic resonance (NMR) imaging (also known as magnetic resonance imaging, mri), such as iodine-123 again, iodine-131, indium-111, fluorine-19, carbon-13, nitrogen-15, oxygen-17, gadolinium, manganese or iron.

Conjugates of an antibody and cytotoxic agent may be made using a variety of bifunctional protein coupling agents such as N-succinimidyl-3-(2-pyridyldithio) propionate (SPDP), succinimidyl-4-(N-maleimidomethyl)cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis(p-azidobenzoyl)hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., Science 238:1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026. The linker may be a "cleavable linker" facilitating release of a cytotoxic drug in the cell. For example, an acid-labile linker, peptidase-sensitive linker, photolabile linker, dimethyl linker or disulfide-containing linker (Chari et al., Cancer Res. 52:127-131 (1992); U.S. Pat. No. 5,208,020) may be used.

The immunuoconjugates or ADCs herein expressly contemplate, but are not limited to such conjugates prepared with cross-linker reagents including, but not limited to, BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, Ill., U.S.A).

In certain embodiments, any of the anti-CD3 antibodies of the invention (e.g., bispecific anti-CD3 antibodies of the invention that bind to CD3 and a second biological molecule, e.g., a cell surface antigen, e.g., a tumor antigen, such as TDB antibodies of the invention or variants thereof) is useful for detecting the presence of CD3 in a biological sample. The term "detecting" as used herein encompasses quantitative or qualitative detection. In certain embodiments, a biological sample comprises a cell or tissue.

In one embodiment, an anti-CD3 antibody for use in a method of diagnosis or detection is provided. In a further aspect, a method of detecting the presence of CD3 in a biological sample is provided. In certain embodiments, the method comprises contacting the biological sample with an anti-CD3 antibody as described herein under conditions permissive for binding of the anti-CD3 antibody to CD3, and detecting whether a complex is formed between the anti-CD3 antibody and CD3. Such method may be an in vitro or in vivo method.

In certain embodiments, labeled anti-CD3 antibodies are provided. Labels include, but are not limited to, labels or moieties that are detected directly (such as fluorescent, chromophoric, electron-dense, chemiluminescent, and radioactive labels), as well as moieties, such as enzymes or ligands, that are detected indirectly, e.g., through an enzymatic reaction or molecular interaction. Exemplary labels include, but are not limited to, the radioisotopes 32P, 14C, 125I, 3H, and 131I, fluorophores such as rare earth chelates or fluorescein and its derivatives, rhodamine and its derivatives, dansyl, umbelliferone, luceriferases, e.g., firefly luciferase and bacterial luciferase (U.S. Pat. No. 4,737,456), luciferin, 2,3-dihydrophthalazinediones, horseradish peroxidase (HRP), alkaline phosphatase, β-galactosidase, glucoamylase, lysozyme, saccharide oxidases, e.g., glucose oxidase, galactose oxidase, and glucose-6-phosphate dehydrogenase, heterocyclic oxidases such as uricase and xanthine oxidase, coupled with an enzyme that employs hydrogen peroxide to oxidize a dye precursor such as HRP, lactoperoxidase, or microperoxidase, biotin/avidin, spin labels, bacteriophage labels, stable free radicals, and the like.

In certain embodiments, the inventive CD3 binding domains and antibodies comprising may be prepared as pharmaceutical formulations (also known as "pharmaceutical compositions") by mixing such antibody having the desired degree of purity with one or more optional pharmaceutically acceptable carriers (Remington's Pharmaceutical Sciences 16th edition, Osol, A. Ed. (1980)), in the form of lyophilized formulations or aqueous solutions. Pharmaceutically acceptable carriers are generally nontoxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG). Exemplary pharmaceutically acceptable carriers herein further include insterstitial drug dispersion agents such as soluble neutral-active hyaluronidase glycoproteins (sHASEGP), for example, human soluble PH-20 hyaluronidase glycoproteins, such as rHuPH20 (HYLENEX®, Baxter International, Inc.). Certain exemplary sHASEGPs and methods of use, including rHuPH20, are described in US Patent Publication Nos. 2005/0260186 and 2006/0104968. In one aspect, a sHASEGP is combined with one or more additional glycosaminoglycanases such as chondroitinases.

Exemplary lyophilized antibody formulations are described in U.S. Pat. No. 6,267,958. Aqueous antibody formulations include those described in U.S. Pat. No. 6,171,586 and WO2006/044908, the latter formulations including a histidine-acetate buffer.

The formulation herein may also contain more than one active ingredients as necessary for the particular indication being treated, preferably those with complementary activities that do not adversely affect each other. For example, it may be desirable to further provide an additional therapeutic agent (e.g., a chemotherapeutic agent, a cytotoxic agent, a growth inhibitory agent, and/or an anti-hormonal agent, such as those recited herein above). Such active ingredients are suitably present in combination in amounts that are effective for the purpose intended.

Active ingredients may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

Sustained-release preparations may be prepared. Suitable examples of sustained-release preparations include semipermeable matrices of solid hydrophobic polymers containing the antibody, which matrices are in the form of shaped articles, for example, films, or microcapsules.

The formulations to be used for in vivo administration are generally sterile. Sterility may be readily accomplished, e.g., by filtration through sterile filtration membranes.

In certain embodiments, the inventive CD3 binding domains and antibodies comprising are used in therapeutic methods.

In one aspect, an anti-CD3 antibody for use as a medicament is provided. In further aspects, an anti-CD3 antibody for use in treating or delaying progression of a cell proliferative disorder (e.g., cancer) or an autoimmune disorder (e.g., arthritis, rheumatoid arthritis, colitis, inflammatory bowel disease, autoimmune type I diabetes, etc.) is provided. In certain embodiments, an anti-CD3 antibody for use in a method of treatment is provided. In certain embodiments, the invention provides an anti-CD3 antibody for use in a method of treating an individual having a cell proliferative disorder or an autoimmune disorder comprising administering to the individual an effective amount of the anti-CD3 antibody. In one such embodiment, the method further comprises administering to the individual an effective amount of at least one additional therapeutic agent, for example, as described below. In further embodiments, the invention provides an anti-CD3 antibody for use in enhancing immune function in an individual having a cell proliferative disorder or an autoimmune disorder. In certain embodiments, the invention provides an anti-CD3 antibody for use in a method of enhancing immune function in an individual having a cell proliferative disorder or an autoimmune disorder comprising administering to the individual an effective of the anti-CD3 antibody to activate effector cells (e.g., T cells, e.g., CD8+ and/or CD4+ T cells including Tregs), expand (increase) an effector cell population, reduce a target cell (e.g., a cell expressing a second biological molecule recognized by an anti-CD3 antibody of the invention, such as a bispecific TDB antibody of the invention) population, and/or kill a target cell (e.g., target tumor cell). An "individual" according to any of the above embodiments may be a human.

In a further aspect, the invention provides for the use of an anti-CD3 antibody in the manufacture or preparation of a medicament. In one embodiment, the medicament is for treatment of a cell proliferative disorder (e.g., cancer) or an autoimmune disorder (e.g., arthritis, rheumatoid arthritis, colitis, inflammatory bowel disease, autoimmune type I diabetes, etc.). In a further embodiment, the medicament is for use in a method of treating a cell proliferative disorder or an autoimmune disorder comprising administering to an individual having a cell proliferative disorder or an autoimmune disorder an effective amount of the medicament. In one such embodiment, the method further comprises administering to the individual an effective amount of at least one additional therapeutic agent, for example, as described below. In a further embodiment, the medicament is for activating effector cells (e.g., T cells, e.g., CD8+ and/or CD4+ T cells including Tregs), expanding (increasing) an effector cell population, reducing a target cell (e.g., a cell expressing a second biological molecule recognized by an anti-CD3 antibody of the invention, such as a bispecific TDB antibody of the invention) population, and/or killing target cells (e.g., target tumor cells) in the individual. In a further embodiment, the medicament is for use in a method of enhancing immune function in an individual having a cell proliferative disorder or an autoimmune disorder comprising administering to the individual an amount effective of the medicament to activate effector cells (e.g., T cells, e.g., CD8+ and/or CD4+ T cells), expand (increase) an effector cell population, reduce a target cell (e.g., a cell expressing a second biological molecule recognized by an anti-CD3 antibody of the invention, such as a bispecific TDB antibody of the invention) population, and/or kill a target cell (e.g., target tumor cell). An "individual" according to any of the above embodiments may be a mammal and, in particular, a human.

In a further aspect, the invention provides a method for treating a disorder comprising a proliferative disorder, an oncological disorder, an immune-oncological disorder, a neurological disorder, a cognitive disorder, a neurodegenerative disorder, an autoimmune disorder. In one embodiment, the method comprises administering to an individual having such disorder an effective amount of an anti-CD3 antibody. In one such embodiment, the method further comprises administering to the individual an effective amount of at least one additional therapeutic agent, for example, as described below. An "individual" according to any of the above embodiments may be a mammal and, in particular, a human.

In a further aspect, the invention provides a method for enhancing immune function in an individual having a disorder in an individual having such disorder. In one embodiment, the method comprises administering to the individual an effective amount of an anti-CD3 antibody to activate effector cells (e.g., T cells, e.g., CD8+ and/or CD4+ T cells), expand (increase) an effector cell population, reduce a target cell population, and/or kill a target cell (e.g., target tumor cell). In one embodiment, an "individual" is a mammal and, in particular, a human.

In a further aspect, the invention provides a method for treating a hematological cancer, such as a B cell cancer (for example, mature B-cell lymphoma) by administering an effective amount of an anti-CD3 antibody of the invention, such as a bispecific TDB antibody of the invention, such as an anti-B cell targeting TDB, such as a CD20-TDB having an anti-CD3 arm and an anti-CD20 arm. In a further aspect of the embodiment, the mature B-cell lymphoma is a Non-Hodgkin's Lymphoma (NHL). In a further aspect of the embodiment, the NHL is selected from the group comprising: germinal-center B-cell-like (GCB) DLBCL, activated B-cell-like (ABC) DLBCL, follicular lymphoma (FL), mantle cell lymphoma (MCL), acute myeloid leukemia (AML), chronic lymphoid leukemia (CLL), marginal zone lymphoma (MZL), small lymphocytic leukemia (SLL), lymphoplasmacytic lymphoma (LL), Waldenstrom macroglobulinemia (WM), central nervous system lymphoma (CNSL), Burkitt's lymphoma (BL), B-cell prolymphocytic leukemia, Splenic marginal zone lymphoma, Hairy cell leukemia, Splenic lymphoma/leukemia, unclassifiable, Splenic diffuse red pulp small B-cell lymphoma, Hairy cell leukemia variant, Waldenstrom macroglobulinemia, Heavy chain diseases, a Heavy chain disease, γ Heavy chain disease, Heavy chain disease, Plasma cell myeloma, Solitary plasmacytoma of bone, Extraosseous plasmacytoma, Extranodal marginal zone lymphoma of mucosa-associated lymphoid tissue (MALT lymphoma), Nodal marginal zone lymphoma, Pediatric nodal marginal zone lymphoma, Pediatric follicular lymphoma, Primary cutaneous follicle centre lymphoma, T-cell/histiocyte rich large B-cell lymphoma, Primary DLBCL of the CNS, Primary cutaneous DLBCL, leg type, EBV-positive DLBCL of the elderly, DLBCL associated with chronic inflammation, Lymphomatoid granulomatosis, Primary mediastinal (thymic) large B-cell lymphoma, Intravascular large B-cell lymphoma, ALK-positive large B-cell lymphoma, Plasmablastic lymphoma, Large B-cell lymphoma arising in HHV8-associated multicentric Castleman disease, Primary effusion lymphoma: B-cell lymphoma, unclassifiable, with features intermediate between diffuse large B-cell lymphoma and Burkitt lymphoma, and B-cell lymphoma, unclassifiable, with features intermediate between diffuse large B-cell lymphoma and classical Hodgkin lymphoma. In a preferred embodiment of the invention, the method comprises treating a cancer comprising germinal-center B-cell-like (GCB) DLBCL, activated B-cell-like (ABC) DLBCL, follicular lymphoma (FL), mantle cell lymphoma (MCL), acute myeloid leukemia (AML), chronic lymphoid leukemia (CLL), marginal zone lymphoma (MZL), small lymphocytic leukemia (SLL), lymphoplasmacytic lymphoma (LL), Waldenstrom macroglobulinemia (WM), central nervous system lymphoma (CNSL), or Burkitt's lymphoma (BL).

In one embodiment, the method comprises administering to an individual having such a hematological cancer (for example, B cell cancer, for example, B cell lymphoma) an effective amount of an anti-CD3 antibody of the invention, such as a bispecific TDB antibody, such as a CD20 TDB comprising an anti-CD20 targeting arm and an anti-CD3 targeting arm. In other embodiments, a CD20 TDB is co-administered with one or more additional therapeutic agents. In one embodiment, the therapeutic agent is an antibody targeting CD20. In one embodiment, a CD20 TDB is co-administered with one or more antibodies targeting CD20 selected from the chimeric monoclonal CD20 antibody, rituximab (Rituxan®) or the monoclonal CD20 antibody, obinutuzumab (Gazyva®). In one embodiment, a CD20 TDB is co-administered with rituximab. In one embodiment, a CD20 TDB is co-administered with obinutuzumab. In one embodiment, a CD20 TDB is co-administered with obinutuzumab and rituximab.

In one further embodiment, the anti-CD3 antibody of the invention (for example, the CD20 TDB), with or without a CD20 monoclonal antibody, is administered with a further chemotherapy agent and/or an antibody-drug conjugate (ADC). In one embodiment, a CD20 TDB is co-administered with one or more additional chemotherapy agents selected from cyclophosphamide, doxorubicin, vincristine, and prednisolone (CHOP). In one embodiment, a CD20 TDB is co-administered with an ADC. In one embodiment, a CD20 TDB is co-administered with CHOP, wherein vincristine is replaced with an ADC. In one embodiment, a CD20 TDB is co-administered with an ADC selected from an anti-CD79b antibody drug conjugate (such as anti-CD79b-MC-vc-PAB-MMAE or the anti-CD79b antibody drug conjugate described in any one of U.S. Pat. No. 8,088,378 and/or US 2014/0030280, or polatuzumab vedotin), an anti-CD19 antibody drug conjugate, an anti-CD22 antibody drug conjugate, an anti-CD45 antibody drug conjugate, and an anti-CD32 drug conjugate.

In one other embodiment the therapeutic agent is a biological modifier. In one embodiment, a CD20 TDB is co-administered with one or more biological modifiers selected from a BCL-2 inhibitor (such as GDC-0199/ABT-199), lenalidomide (Revlimid®), a PI3K-delta inhibitor (such as idelalisib (Zydelig®)), a PD-1 axis binding antagonist, an agonist, e.g., agonist antibody, directed against an activating co-stimulatory molecule, e.g., CD40, CD226, CD28, OX40 (e.g., AgonOX), GITR, CD137 (also known as TNFRSF9, 4-1 BB, or ILA), CD27 (e.g., CDX-1127), HVEM, or CD127, an antagonist, e.g., antagonist antibody, directed against an inhibitory co-stimulatory molecule, e.g., CTLA-4 (also known as CD152), PD-1, TIM-3, BTLA, VISTA, LAG-3, B7-H3, B7-H4, IDO (e.g., 1-methyl-D-tryptophan (also known as 1-D-MT)), TIGIT, MICA/B, GITR (e.g., TRX518) or arginase, ipilimumab (also known as MDX-010, MDX-101, or Yervoy®), tremelimumab (also known as ticilimumab or CP-675,206, urelumab (also known as BMS-663513), MGA271, an antagonist directed against a TGF beta, e.g., metelimumab (also known as CAT-192), fresolimumab (also known as GC1008), LY2157299k, and an adoptive transfer of a T cell (e.g., a cytotoxic T cell or CTL) expressing a chimeric antigen receptor (CAR), e.g., adoptive transfer of a T cell comprising a dominant-negative TGF beta receptor, e.g, a dominant-negative TGF beta type II receptor.

In one embodiment, a CD20 TDB is co-administered with rituximab and one or more chemotherapy agents. In one such embodiment, a CD20 TDB is co-administered with rituximab and CHOP. In one embodiment, a CD20 TDB is co-administered with rituximab and an ADC. In one embodiment, a CD20 TDB is co-administered with rituximab and CHOP, wherein vincristine is replaced with an ADC. In one embodiment, a CD20 TDB is co-administered with an ADC selected from an anti-CD79b antibody drug conjugate (such as anti-CD79b-MC-vc-PAB-MMAE or the anti-CD79b antibody drug conjugate described in any one of U.S. Pat. No. 8,088,378 and/or US 2014/0030280, or polatuzumab vedotin), an anti-CD19 antibody drug conjugate, an anti-CD22 antibody drug conjugate, an anti-CD45 antibody drug conjugate, and an anti-CD32 drug conjugate. In one embodiment, a CD20 TDB is co-administered with rituximab and one or more biological modifiers selected from a BCL-2 inhibitor (such as GDC-0199/ABT-199), lenalidomide (Revlimid®), a PI3K-delta inhibitor (such as idelalisib (Zydelig®)), a PD-1 axis binding antagonist, an agonist, e.g., agonist antibody, directed against an activating co-stimulatory molecule, e.g., CD40, CD226, CD28, OX40 (e.g., AgonOX), GITR, CD137 (also known as TNFRSF9, 4-1 BB, or ILA), CD27 (e.g., CDX-1127), HVEM, or CD127, an antagonist, e.g., antagonist antibody, directed against an inhibitory co-stimulatory molecule, e.g., CTLA-4 (also known as CD152), PD-1, TIM-3, BTLA, VISTA, LAG-3, B7-H3, B7-H4, IDO (e.g., 1-methyl-D-tryptophan (also known as 1-D-MT)), TIGIT, MICA/B, GITR (e.g., TRX518) or arginase, ipilimumab (also known as MDX-010, MDX-101, or Yervoy®), tremelimumab (also known as ticilimumab or CP-675,206, urelumab (also known as BMS-663513), MGA271, an antagonist directed against a TGF beta, e.g., metelimumab (also known as CAT-192), fresolimumab (also known as GC1008), LY2157299k, and an adoptive transfer of a T cell (e.g., a cytotoxic T cell or CTL) expressing a chimeric antigen receptor (CAR), e.g., adoptive transfer of a T cell comprising a dominant-negative TGF beta receptor, e.g, a dominant-negative TGF beta type II receptor.

In one embodiment, a CD20 TDB is co-administered with rituximab, one or more chemotherapy agents, and one or more biological modifiers selected from a BCL-2 inhibitor (such as GDC-0199/ABT-199), lenalidomide (Revlimid®), a PI3K-delta inhibitor (such as idelalisib (Zydelig®)), a PD-1 axis binding antagonist, an agonist, e.g., agonist antibody, directed against an activating co-stimulatory molecule, e.g., CD40, CD226, CD28, OX40 (e.g., AgonOX), GITR, CD137 (also known as TNFRSF9, 4-1 BB, or ILA), CD27 (e.g., CDX-1127), HVEM, or CD127, an antagonist, e.g., antagonist antibody, directed against an inhibitory co-stimulatory molecule, e.g., CTLA-4 (also known as CD152), PD-1, TIM-3, BTLA, VISTA, LAG-3, B7-H3, B7-H4, IDO (e.g., 1-methyl-D-tryptophan (also known as 1-D-MT)), TIGIT, MICA/B, GITR (e.g., TRX518) or arginase, ipilimumab (also known as MDX-010, MDX-101, or Yervoy®), tremelimumab (also known as ticilimumab or CP-675,206, urelumab (also known as BMS-663513), MGA271, an antagonist directed against a TGF beta, e.g., metelimumab (also known as CAT-192), fresolimumab (also known as GC1008), LY2157299k, and an adoptive transfer of a T cell (e.g., a cytotoxic T cell or CTL) expressing a chimeric antigen receptor (CAR), e.g., adoptive transfer of a T cell comprising a dominant-negative TGF beta receptor, e.g, a dominant-negative TGF beta type II receptor.

In one embodiment, a CD20 TDB is co-administered with rituximab, an ADC, and one or more biological modifiers selected from a BCL-2 inhibitor (such as GDC-0199/ABT-199), lenalidomide (Revlimid®), a PI3K-delta inhibitor (such as idelalisib (Zydelig®)), a PD-1 axis binding antagonist, an agonist, e.g., agonist antibody, directed against an activating co-stimulatory molecule, e.g., CD40, CD226, CD28, OX40 (e.g., AgonOX), GITR, CD137 (also known as TNFRSF9, 4-1 BB, or ILA), CD27 (e.g., CDX-1127), HVEM, or CD127, an antagonist, e.g., antagonist antibody, directed against an inhibitory co-stimulatory molecule, e.g., CTLA-4 (also known as CD152), PD-1, TIM-3, BTLA, VISTA, LAG-3, B7-H3, B7-H4, IDO (e.g., 1-methyl-D-tryptophan (also known as 1-D-MT)), TIGIT, MICA/B, GITR (e.g., TRX518) or arginase, ipilimumab (also known as MDX-010, MDX-101, or Yervoy®), tremelimumab (also known as ticilimumab or CP-675,206, urelumab (also known as BMS-663513), MGA271, an antagonist directed against a TGF beta, e.g., metelimumab (also known as CAT-192), fresolimumab (also known as GC1008), LY2157299k, and an adoptive transfer of a T cell (e.g., a cytotoxic T cell or CTL) expressing a chimeric antigen receptor (CAR), e.g., adoptive transfer of a T cell comprising a dominant-negative TGF beta receptor, e.g, a dominant-negative TGF beta type II receptor.

In one embodiment, a CD20 TDB is co-administered with obinutuzumab and one or more chemotherapy agents. In one embodiment, a CD20 TDB is co-administered with obinutuzumab and CHOP. In one embodiment, a CD20 TDB is co-administered with obinutuzumab and an ADC. In one embodiment, a CD20 TDB is co-administered with obinutuzumab and CHOP, wherein vincristine is replaced with an ADC. In one embodiment, a CD20 TDB is co-administered with an ADC selected from an anti-CD79b antibody drug conjugate (such as anti-CD79b-MC-vc-PAB-MMAE or the anti-CD79b antibody drug conjugate described in any one of U.S. Pat. No. 8,088,378 and/or US 2014/0030280, or polatuzumab vedotin), an anti-CD19 antibody drug conjugate, an anti-CD22 antibody drug conjugate, an anti-CD45 antibody drug conjugate, and an anti-CD32 drug conjugate. In one embodiment, a CD20 TDB is co-administered with obinutuzumab and one or more biological modifiers selected from a BCL-2 inhibitor (such as GDC-0199/ABT-199), lenalidomide (Revlimid®), a PI3K-delta inhibitor (such as idelalisib (Zydelig®)), a PD-1 axis binding antagonist, an agonist, e.g., agonist antibody, directed against an activating co-stimulatory molecule, e.g., CD40, CD226, CD28, OX40 (e.g., AgonOX), GITR, CD137 (also known as TNFRSF9, 4-1 BB, or ILA), CD27 (e.g., CDX-1127), HVEM, or CD127, an antagonist, e.g., antagonist antibody, directed against an inhibitory co-stimulatory molecule, e.g., CTLA-4 (also known as CD152), PD-1, TIM-3, BTLA, VISTA, LAG-3, B7-H3, B7-H4, IDO (e.g., 1-methyl-D-tryptophan (also known as 1-D-MT)), TIGIT, MICA/B, GITR (e.g., TRX518) or arginase, ipilimumab (also known as MDX-010, MDX-101, or Yervoy®), tremelimumab (also known as ticilimumab or CP-675,206, urelumab (also known as BMS-663513), MGA271, an antagonist directed against a TGF beta, e.g., metelimumab (also known as CAT-192), fresolimumab (also known as GC1008), LY2157299k, and an adoptive transfer of a T cell (e.g., a cytotoxic T cell or CTL) expressing a chimeric antigen receptor (CAR), e.g., adoptive transfer of a T cell comprising a dominant-negative TGF beta receptor, e.g, a dominant-negative TGF beta type II receptor.

In one embodiment, a CD20 TDB is co-administered with obinutuzumab, an ADC, and one or more biological modifiers selected from a BCL-2 inhibitor (such as GDC-0199/ABT-199), lenalidomide (Revlimid®), a PI3K-delta inhibitor (such as idelalisib (Zydelig®)), a PD-1 axis binding antagonist, an agonist, e.g., agonist antibody, directed against an activating co-stimulatory molecule, e.g., CD40, CD226, CD28, OX40 (e.g., AgonOX), GITR, CD137 (also known as TNFRSF9, 4-1 BB, or ILA), CD27 (e.g., CDX-1127), HVEM, or CD127, an antagonist, e.g., antagonist antibody, directed against an inhibitory co-stimulatory molecule, e.g., CTLA-4 (also known as CD152), PD-1, TIM-3, BTLA, VISTA, LAG-3, B7-H3, B7-H4, IDO (e.g., 1-methyl-D-tryptophan (also known as 1-D-MT)), TIGIT, MICA/B, GITR (e.g., TRX518) or arginase, ipilimumab (also known as MDX-010, MDX-101, or Yervoy®), tremelimumab (also known as ticilimumab or CP-675,206, urelumab (also known as BMS-663513), MGA271, an antagonist directed against a TGF beta, e.g., metelimumab (also known as CAT-192), fresolimumab (also known as GC 1008), LY2157299k, and an adoptive transfer of a T cell (e.g., a cytotoxic T cell or CTL) expressing a chimeric antigen receptor (CAR), e.g., adoptive transfer of a T cell comprising a dominant-negative TGF beta receptor, e.g, a dominant-negative TGF beta type II receptor.

In a further aspect of the invention, the additional therapy comprises an anti-CD20 antibody. In one embodiment, the anti-CD20 antibody is rituximab. In one embodiment, the anti-CD20 antibody is a humanized B-Ly1 antibody. In one embodiment, the humanized B-Ly1 antibody is obinituzumab. In one embodiment, the anti-CD20 antibody is ofatumumab, ublituximab, and/or ibritumomab tiuxetan.

In a further aspect of the invention, the additional therapy comprises an alkylating agent. In one embodiment, the alkylating agent is 4-[5-[Bis(2-chloroethyl)amino]-1-methylbenzimidazol-2-yl]butanoic acid and salts thereof. In one embodiment, the alkylating agent is bendamustine.

In a further aspect of the invention, the additional therapy comprises a BCL-2 inhibitor. In one embodiment, the BCL-2 inhibitor is 4-(4-{[2-(4-chlorophenyl)-4,4-dimethylcyclohex-1-en-1-yl]methyl}piperazin-1-yl)-N-({3-nitro-4-[(tetrahydro-2H-pyran-4-ylmethyl)amino]phenyl}sulfonyl)-2-(1H-pyrrolo[2,3-b]pyridin-5-yloxy)benzamide and salts thereof. In one embodiment, the BCL-2 inhibitor is venetoclax (CAS #: 1257044-40-8).

In a further aspect of the invention, the additional therapy comprises a phosphoinositide 3-kinase (PI3K) inhibitor. In one embodiment, the PI3K inhibitor inhibits delta isoform PI3K (i.e., P1106). In some embodiments, the PI3K inhibitor is 5-Fluoro-3-phenyl-2-[(1S)-1-(7H-purin-6-ylamino)propyl]-4(3H)-quinazolinone and salts thereof. In some embodiments, the PI3K inhibitor is idelalisib (CAS #: 870281-82-6). In one embodiment, the PI3K inhibitor inhibits alpha and delta isoforms of PI3K. In some embodiments, the PI3K inhibitor is 2-{3-[2-(1-Isopropyl-3-methyl-1H-1, 2-4-triazol-5-yl)-5,6-dihydrobenzo[f]imidazo[1,2-d][1,4] oxazepin-9-yl]-1H-pyrazol-1-yl}-2-methylpropanamide and salts thereof.

In a further aspect of the invention, the additional therapy comprises a Bruton's tyrosine kinase (BTK) inhibitor. In one embodiment, the BTK inhibitor is 1-[(3R)-3-[4-Amino-3-(4-phenoxyphenyl)-1H-pyrazolo[3,4-d]pyrimidin-1-yl]piperidin-1-yl]prop-2-en-1-one and salts thereof. In one embodiment, the BTK inhibitor is ibrutinib (CAS #: 936563-96-1).

In a further aspect of the invention, the additional therapy comprises thalidomide or a derivative thereof. In one embodiment, the thalidomide or a derivative thereof is (RS)-3-(4-Amino-1-oxo 1,3-dihydro-2H-isoindol-2-yl)piperidine-2,6-dione and salts thereof. In one embodiment, the thalidomide or a derivative thereof is lendalidomide (CAS #: 191732-72-6).

In a further aspect of the invention, the additional therapy comprises one or more of cyclophosphamide, doxorubicin, vincristine, or prednisolone (CHOP). In one embodiment, the additional therapy further comprises an anti-CD20 antibody as described above (e.g., GA-101 and/or Rituxan®). Any of the above methods and therapies may be used, without limitation, for any cancer, including, for example, treatment of a B-cell cancer or breast cancer.

In a further aspect, the invention provides a method for treating HER2-positive cancers. In one embodiment, the method comprises administering to an individual having such a cancer an effective amount of an anti-HER2 antibody of the invention, such as a bispecific TDB antibody with an anti-HER2 targeting arm and an anti-CD3 targeting arm. In a preferred embodiment, the HER2-TDB possesses an acceptable toxicity profile when administered in an effective dose in a patient. In one embodiment, the CD3 arm of the HER2-TDB with an acceptable toxicity profile is a low affinity CD3 arm. In one embodiment, the CD3 arm of the HER2-TDB with an acceptable toxicity profile is 40G5c.

In a preferable embodiment, the HER2-positive cancer is a HER2-positive breast cancer or HER2-positive gastric cancer. In one embodiment, a HER2 TDB is co-administered with one or more additional therapeutic agents that target the HER pathway. In one embodiment, the therapeutic agent that targets the HER pathway is selected from an EGFR inhibitor, a HER2 inhibitor, a HER3 inhibitor, and/or a HER4 inhibitor. In one embodiment, a HER2 TDB is co-administered with one or more additional therapeutic agents selected from trastuzumab (Herceptin®), T-DM1 (Kadcyla®) and pertuzumab (Perjeta®). In one embodiment, a HER2 TDB is co-administered with trastuzumab. In one embodiment, a HER2 TDB is co-administered with T-DM1. In one embodiment, a HER2 TDB is co-administered with pertuzumab. In one embodiment, a HER2 TDB is co-administered with trastuzumab and pertuzumab. In one embodiment, a HER2 TDB is co-administered with T-DM1 and pertuzumab.

In a further aspect, the invention provides pharmaceutical formulations comprising any of the anti-CD3 antibodies provided herein, e.g., for use in any of the above therapeutic methods. In one embodiment, a pharmaceutical formulation comprises any of the anti-CD3 antibodies provided herein and a pharmaceutically acceptable carrier. In another embodiment, a pharmaceutical formulation comprises any of the anti-CD3 antibodies provided herein and at least one additional therapeutic agent, for example, as described herein.

Antibodies of the invention can be used either alone or in combination with other agents in a therapy. For instance, an antibody of the invention may be co-administered with at least one additional therapeutic agent. In certain embodiments, an additional therapeutic agent is a chemotherapeutic agent, growth inhibitory agent, cytotoxic agent, agent used in radiation therapy, anti-angiogenesis agent, apoptotic agent, anti-tubulin agent, or other agent, such as a epidermal growth factor receptor (EGFR) antagonist (e.g., a tyrosine kinase inhibitor), HER1/EGFR inhibitor (e.g., erlotinib (Tarceva™)), platelet derived growth factor inhibitor (e.g., Gleevec™ (Imatinib Mesylate)), a COX-2 inhibitor (e.g., celecoxib), interferon, cytokine, antibody other than the anti-CD3 antibody of the invention, such as an antibody that bind to one or more of the following targets ErbB2, ErbB3, ErbB4, PDGFR-beta, BlyS, APRIL, BCMA VEGF, or VEGF receptor(s), TRAIL/Apo2, PD-1, PD-L1, PD-L2, or another bioactive or organic chemical agent.

In some embodiments, the invention provides a method wherein the additional therapeutic agent is a glucocorticoid. In one embodiment, the glucocorticoid is dexamethasone.

Such combination therapies noted above encompass combined administration (where two or more therapeutic agents are included in the same or separate formulations), and separate administration, in which case, administration of the antibody of the invention can occur prior to, simultaneously, and/or following, administration of the additional therapeutic agent or agents. In one embodiment, administration of the anti-CD3 antibody and administration of an additional therapeutic agent occur within about one month, or within about one, two or three weeks, or within about one, two, three, four, five, or six days, of each other. Anti-CD3 antibodies of the invention (e.g., bispecific anti-CD3 antibodies of the invention that bind to CD3 and a second biological molecule, e.g., a cell surface antigen, e.g., a tumor antigen, such as a TDB antibody of the invention or variant thereof) can also be used in combination with radiation therapy.

An antibody of the invention (and/or any additional therapeutic agent) can be administered by any suitable means, including parenteral, intrapulmonary, and intranasal, and, if desired for local treatment, intralesional administration. Parenteral infusions include intramuscular, intravenous, intraarterial, intraperitoneal, or subcutaneous administration. In some embodiments, the antibody is administered by subcutaneous administration. In some embodiments, an anti-CD3 antibody administered by subcutaneous injection exhibits a less toxic response in a patient than the same anti-CD3 antibody administered by intravenous injection. Dosing can be by any suitable route, for example, by injections, such as intravenous or subcutaneous injections, depending in part on whether the administration is brief or chronic. Various dosing schedules including but not limited to single or multiple administrations over various time-points, bolus administration, and pulse infusion are contemplated herein.

Antibodies of the invention would be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners. The antibody need not be, but is optionally formulated with one or more agents currently used to prevent or treat the disorder in question. The effective amount of such other agents depends on the amount of antibody present in the formulation, the type of disorder or treatment, and other factors discussed above. These are generally used in the same dosages and with administration routes as described herein, or about from 1 to 99% of the dosages described herein, or in any dosage and by any route that is empirically/clinically determined to be appropriate.

For the prevention or treatment of disease, the appropriate dosage of an antibody of the invention (when used alone or in combination with one or more other additional therapeutic agents) will depend on the type of disease to be treated, the type of antibody, the severity and course of the disease, whether the antibody is administered for preventive or therapeutic purposes, previous therapy, the patient's clinical history and response to the antibody, and the discretion of the attending physician. The antibody is suitably administered to the patient at one time or over a series of treatments.

As a general proposition, the therapeutically effective amount of the anti-CD3 antibody administered to human will be in the range of about 0.01 to about 100 mg/kg of patient body weight whether by one or more administrations. In some embodiments, the antibody used is about 0.01 to about 45 mg/kg, about 0.01 to about 40 mg/kg, about 0.01 to about 35 mg/kg, about 0.01 to about 30 mg/kg, about 0.01 to about 25 mg/kg, about 0.01 to about 20 mg/kg, about 0.01 to about 15 mg/kg, about 0.01 to about 10 mg/kg, about 0.01 to about 5 mg/kg, or about 0.01 to about 1 mg/kg administered daily, for example. In one embodiment, an anti-CD3 antibody described herein is administered to a human at a dose of about 100 mg, about 200 mg, about 300 mg, about 400 mg, about 500 mg, about 600 mg, about 700 mg, about 800 mg, about 900 mg, about 1000 mg, about 1100 mg, about 1200 mg, about 1300 mg or about 1400 mg on day 1 of 21-day cycles. The dose may be administered as a single dose or as multiple doses (e.g., 2 or 3 doses), such as infusions. For repeated administrations over several days or longer, depending on the condition, the treatment would generally be sustained until a desired suppression of disease symptoms occurs. One exemplary dosage of the antibody would be in the range from about 0.05 mg/kg to about 10 mg/kg. Thus, one or more doses of about 0.5 mg/kg, 2.0 mg/kg, 4.0 mg/kg, or 10 mg/kg (or any combination thereof) may be administered to the patient. Such doses may be administered intermittently, for example, every week or every three weeks (e.g., such that the patient receives from about two to about twenty, or, for example, about six doses of the anti-CD3 antibody). An initial higher loading dose, followed by one or more lower doses may be administered. The progress of this therapy is easily monitored by conventional techniques and assays.

In some embodiments, the methods may further comprise an additional therapy. The additional therapy may be radiation therapy, surgery, chemotherapy, gene therapy, DNA therapy, viral therapy, RNA therapy, immunotherapy, bone marrow transplantation, nanotherapy, monoclonal antibody therapy, or a combination of the foregoing. The additional therapy may be in the form of adjuvant or neoadjuvant therapy. In some embodiments, the additional therapy is the administration of small molecule enzymatic inhibitor or anti-metastatic agent. In some embodiments, the additional therapy is the administration of side-effect limiting agents (e.g., agents intended to lessen the occurrence and/or severity of side effects of treatment, such as anti-nausea agents, etc.). In some embodiments, the additional therapy is radiation therapy. In some embodiments, the additional therapy is surgery. In some embodiments, the additional therapy is a combination of radiation therapy and surgery. In some embodiments, the additional therapy is gamma irradiation. In some embodiments, the additional therapy may be a separate administration of one or more of the therapeutic agents described above.

In another aspect of the invention, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper pierceable by a hypodermic injection needle). At least one active agent in the composition is an antibody of the invention. The label or package insert indicates that the composition is used for treating the condition of choice. Moreover, the article of manufacture may comprise (a) a first container with a composition contained therein, wherein the composition comprises an antibody of the invention; and (b) a second container with a composition contained therein, wherein the composition comprises a further cytotoxic or otherwise therapeutic agent. The article of manufacture in this embodiment of the invention may further comprise a package insert indicating that the compositions can be used to treat a particular condition. Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

EXAMPLES

Example 1: Isolation of Anti-CD3 Antibodies from Immunized Mice, and Generation and Isolation of Humanized and Optimized Variants Immunizations were carried out as in FIG. 1. Briefly, balb/c mice were immunized with a primary immunization with $1.0 \times 10^6$ human T cells (which express CD3 epsilon) and Sigma® adjuvant in each of ten mice. Twenty-eight days after the primary immunization, a first immunization boost with $1.0 \times 10^6$ human T cells (which express CD3 epsilon) and Sigma® adjuvant was performed in each of the ten mice. Twenty-eight days after the first immunization boost, the ten mice were given a second immunization boost with $1.5 \times 10^6$ T cells (which express CD3 epsilon) and Sigma® adjuvant; however, for this second boost, five of the mice received human T cells (which express CD3 epsilon) and the other five mice received cynomolgus (cyno) T cells (which express cyno CD3 epsilon). Forty-two days after the second immunization boost, all ten mice received a third immunization boost of fifty micrograms of denatured recombinant cyno CD3epsilon protein mixed with seven micrograms of a peptide-BSA conjugate in which the peptide corresponded to an N-terminal peptide of the native cyno CD3 epsilon protein. Seven days after the third immunization boost, the ten mice were sacrificed and spleens were harvested for B cell sorting.

Figure 2:
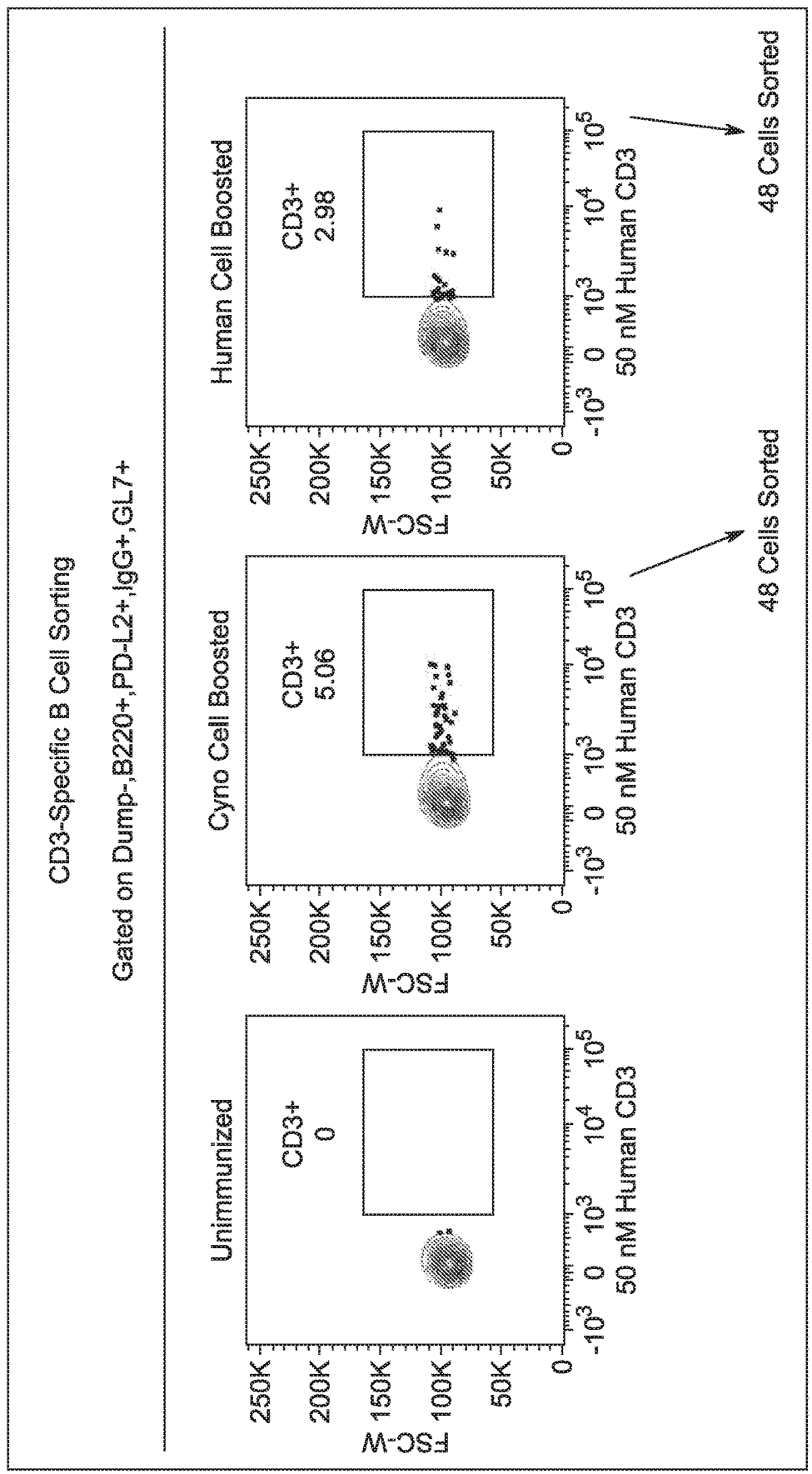
FIG. 2 shows an exemplary flow cytometry-based sorting result in which 48 cells were isolated and sorted from each of the cyno-boosted and human-boosted sets of mice.
Figure 3:
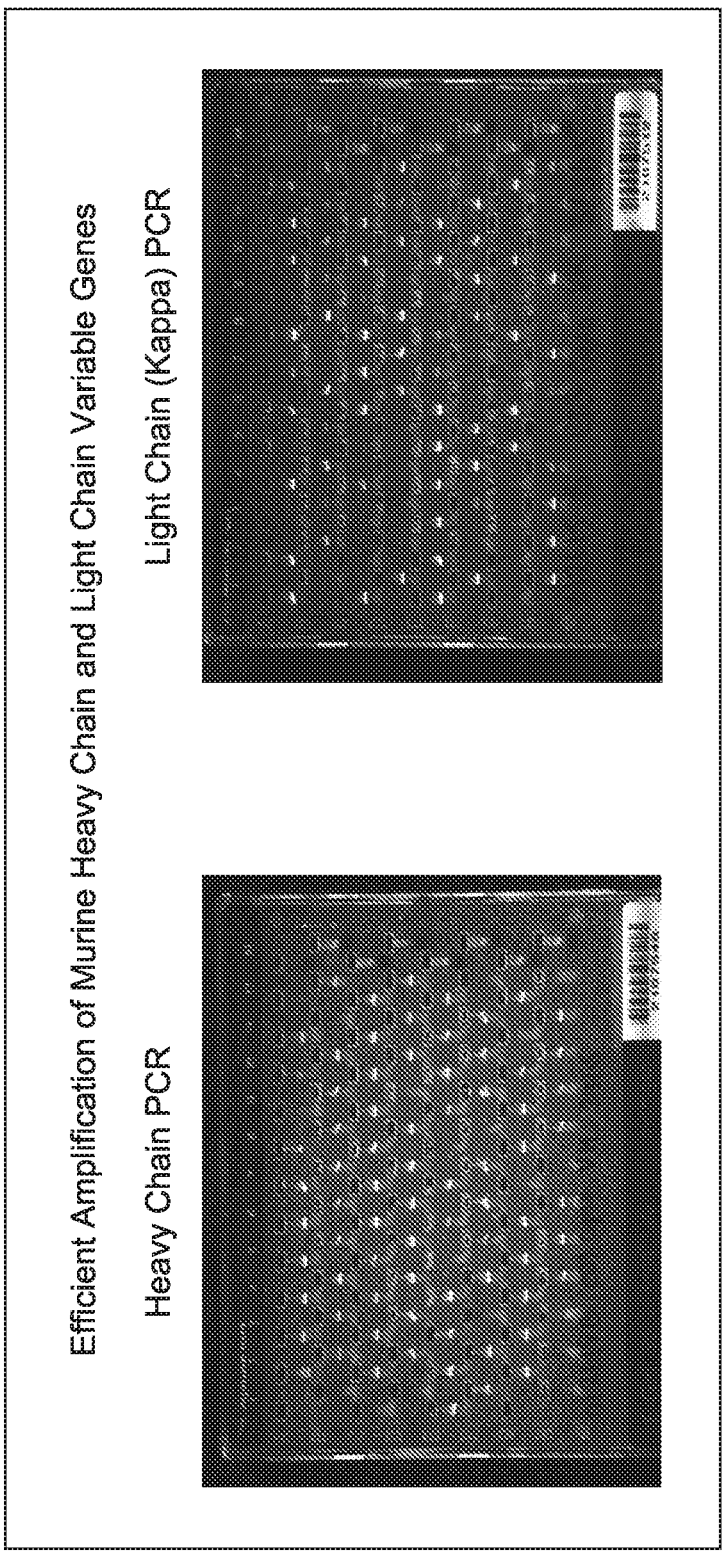
FIG. 3 shows exemplary agarose gels confirming efficient amplification of murine heavy chain and light chain variable genes.

Splenic B cells obtained from the harvested spleens were stained with 50 nM recombinant, biotinylated CD3epsilon using routine methods (see, e.g., Tiller et al, *J Immunol Methods*, Vol. 329, pages 112-124, doi: 10.1016/j.jim.2007.09.017 (2008). CD3epsilon-specific B cells were single-cell sorted by flow cytometry using standard methods (see, e.g., Tiller et al, *J Immunol Methods*, Vol. 329, pages 112-124, doi:10.1016/j.jim.2007.09.017 (2008); WO 2009/036379; WO 2010/105256; and WO 2012/009568). Cognate heavy and light chain pairs were amplified by single-cell PCR using a previously described primer set (see, e.g., Tiller et al, *J Immunol Methods*, Vol. 329, pages 112-124, doi: 10.1016/j.jim.2007.09.017 (2008). An exemplary flow cytometry-based sorting result is depicted in FIG. 2, in which 48 cells were isolated and sorted from each of the cyno-boosted (middle flow plot of FIG. 2) and human-boosted (right flow plot of FIG. 2) sets of mice. Amplicons were confirmed by agarose gel electrophoresis (FIG. 3) and transformed into a highly-engineered strain of *Saccharomyces cerevisiae* (see, e.g., Xu et al., *Protein Eng Des Sel*. Vol. 26(10), pages 663-670 (2013) doi: 10.1093/protein/gzt047; Sivasubramanian et al., *MAbs*. Vol. 9(1), pages 29-42 (2017) doi: 10.1080/19420862.2016.1246096; WO 2009/036379; WO 2010/105256; and WO 2012/009568).

Figure 4A:
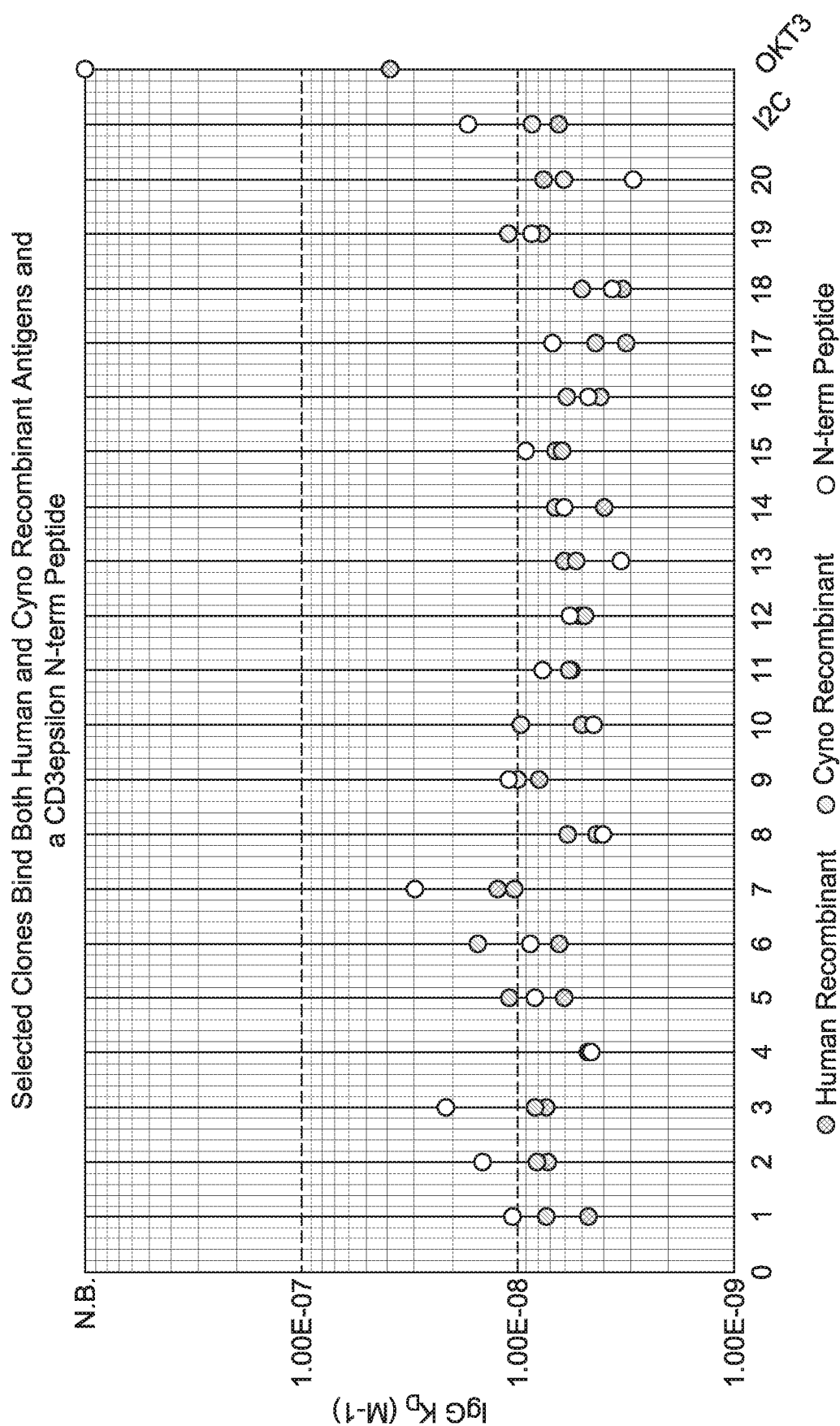
FIG. 4 shows exemplary selected clones that bind both human and cyno recombinant antigens and a CD3 epsilon N-terminal peptide (A), and the antibody identities and sequence information associated with each of the clones (SEQ ID NOs: 6482-6586) (B).
Figure 5:
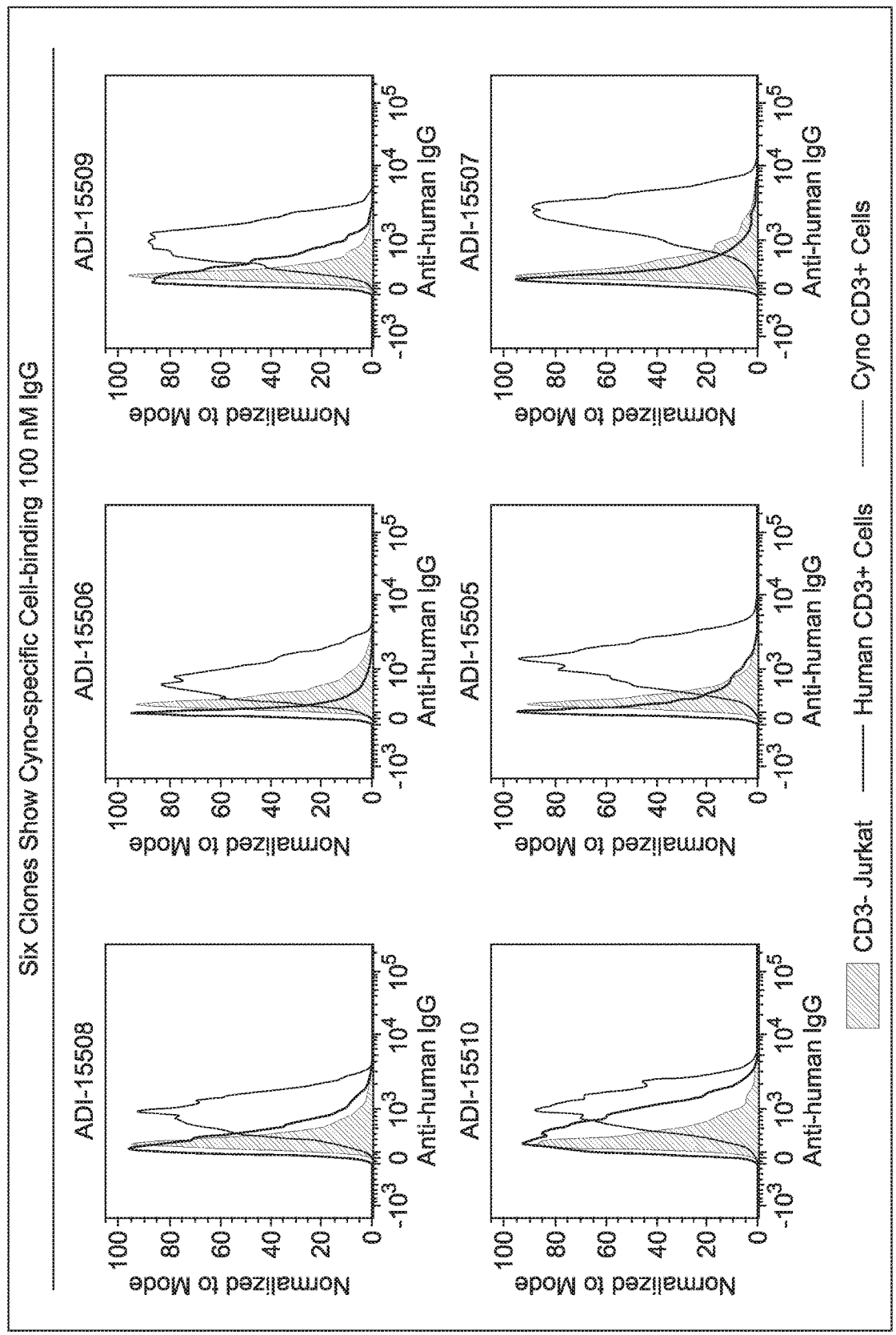
FIG. 5 shows exemplary clones that are cyno-CD3 epsilon-specific.
Figure 6:
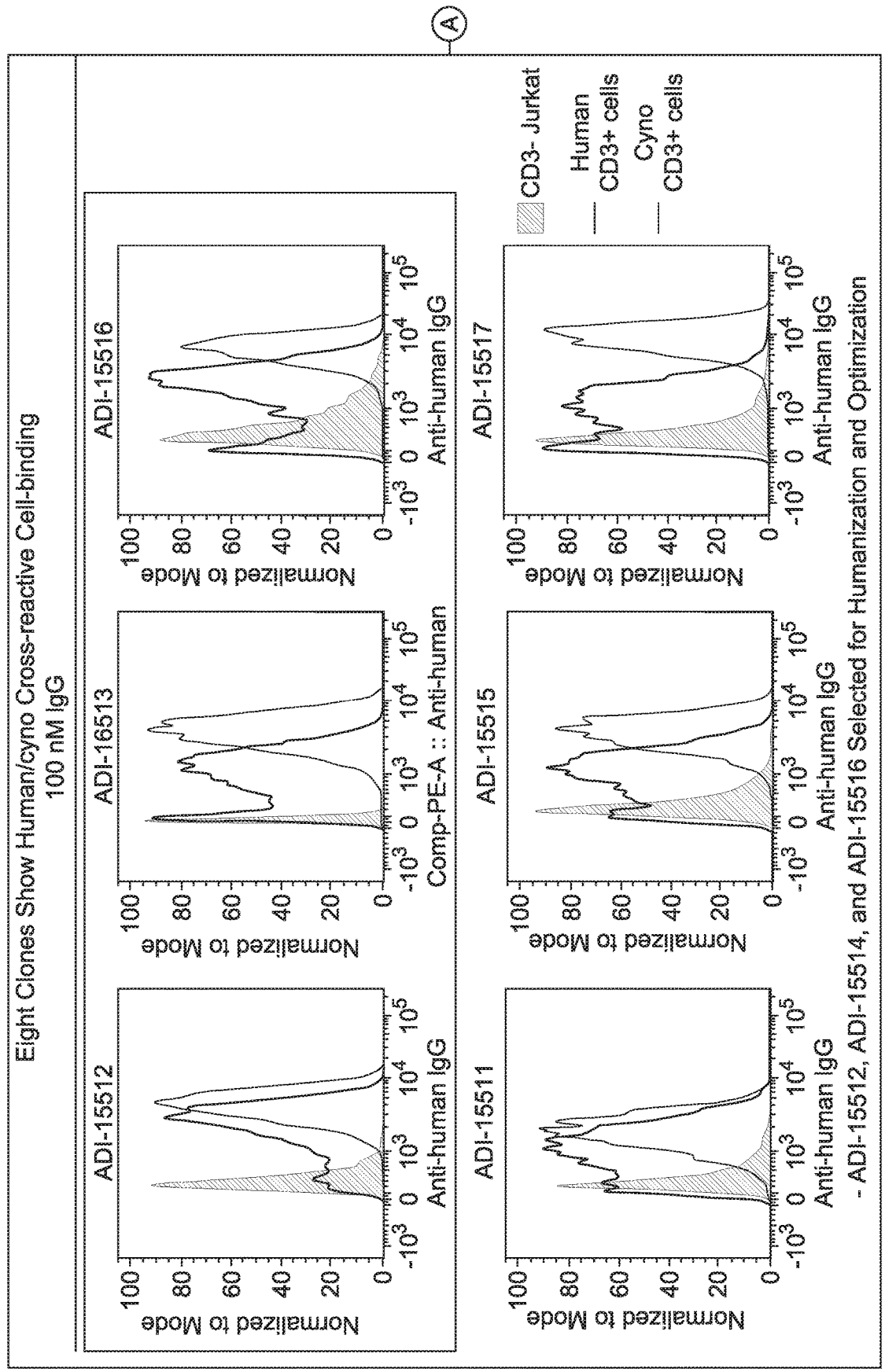
FIG. 6 shows exemplary clones that are human- and cyno-CD3 epsilon cross-reactive.
Figure 6:
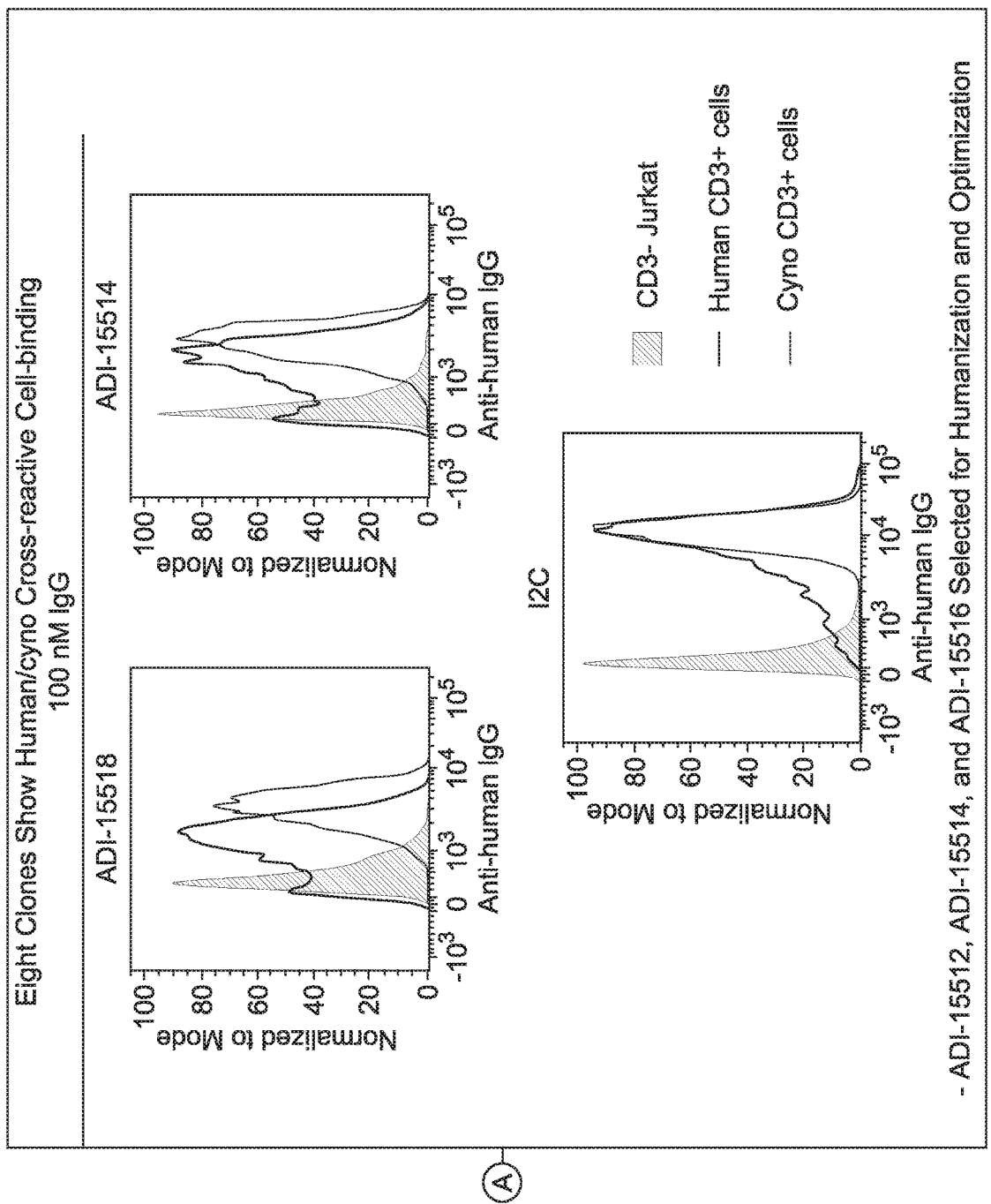
Figure 7:
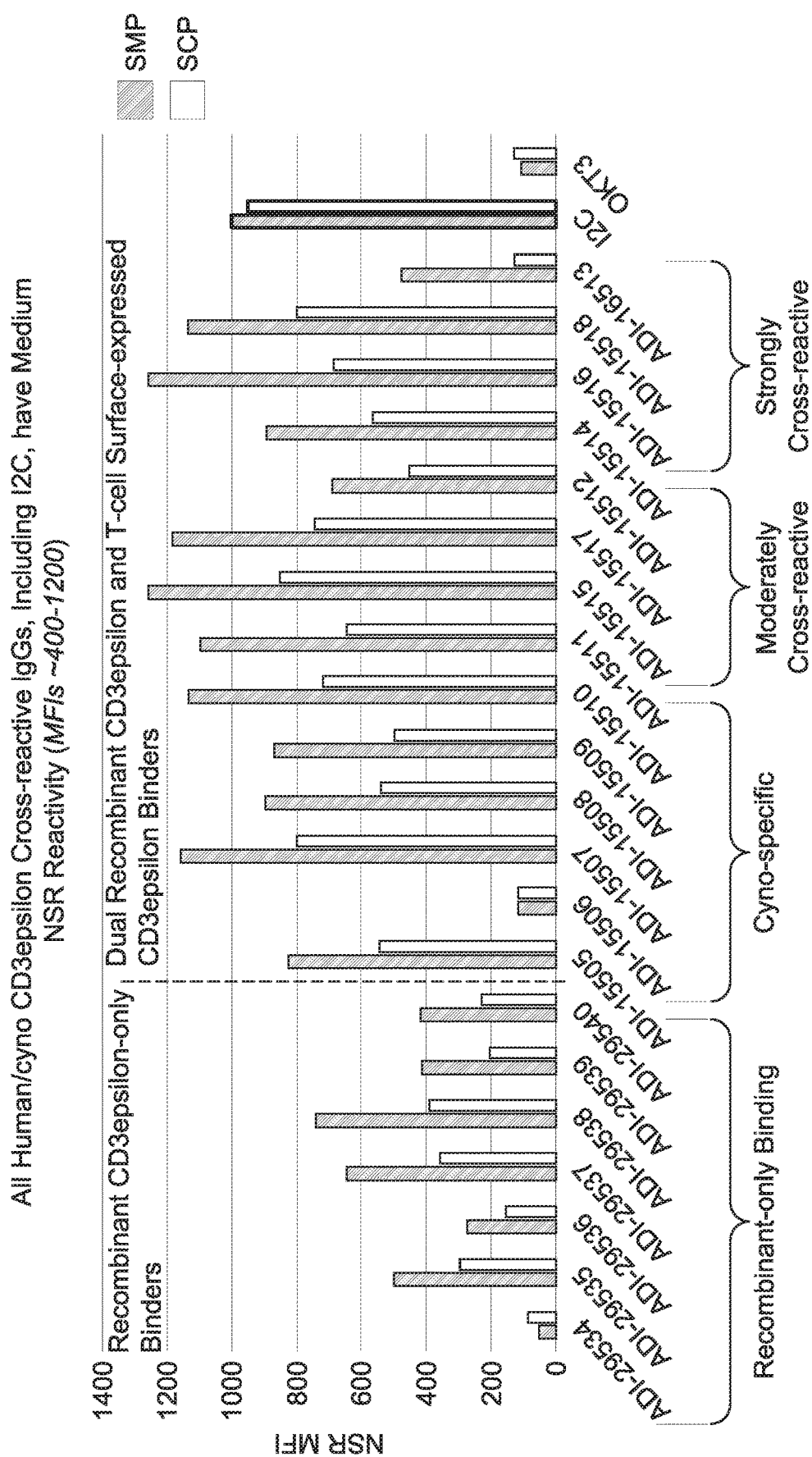
FIG. 7 shows an exemplary graph showing all human- and cyno-CD3 epsilon cross-reactive IgGs, including I2G, have medium NSR reactivity.

Antibodies were expressed in *Saccharomyces cerevisiae*, purified using standard procedures, and assayed for binding activity (see, e.g., Xu et al., *Protein Eng Des Sel*. Vol. 26(10), pages 663-670 (2013) doi: 10.1093/protein/gzt047; Sivasubramanian et al., *MAbs*. Vol. 9(1), pages 29-42 (2017) doi: 10.1080/19420862.2016.1246096; WO 2009/036379; WO 2010/105256; and WO 2012/009568. Twenty-one clones bound to recombinant human CD3 epsilon (see, e.g., FIG. 4A for relative binding affinities, and FIG. 4B for antibody identities and sequence information associated with each of the 21 clones). Of these 21 clones, 14 also bound T cell-surface expressed CD3 epsilon (see, collectively, FIGS. 5, 6, and FIG. 7). Of these 14 clones that bind T cell-surface expressed CD3epsilon, six of these were cyno CD3 epsilon-specific (see FIG. 5), while eight of these bound both human- and cyno-CD3 epsilon (see FIGS. 6 and 7). Competitive binding assays showed that all of the CD3 epsilon-binding clones bound to epitopes overlapping that of I2C and did not compete significantly with OKT3 (FIG. 8).

Figure 9:
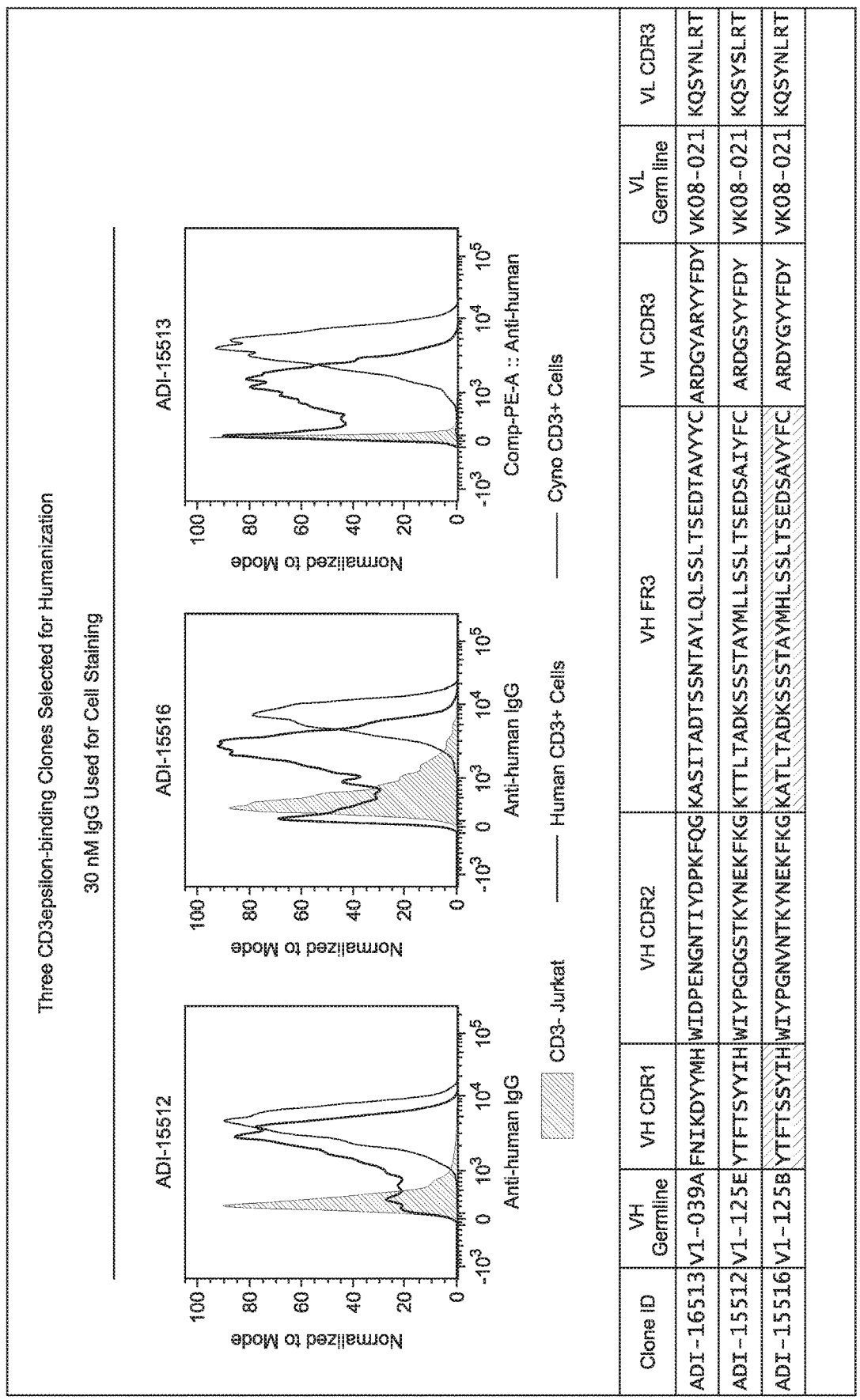
FIG. 9 shows exemplary high affinity CD3 epsilon-binding clones (ADI-15512, ADI-15516, and ADI-16513) selected for humanization (SEQ ID NOs: 6587-6601).
Figure 10B:
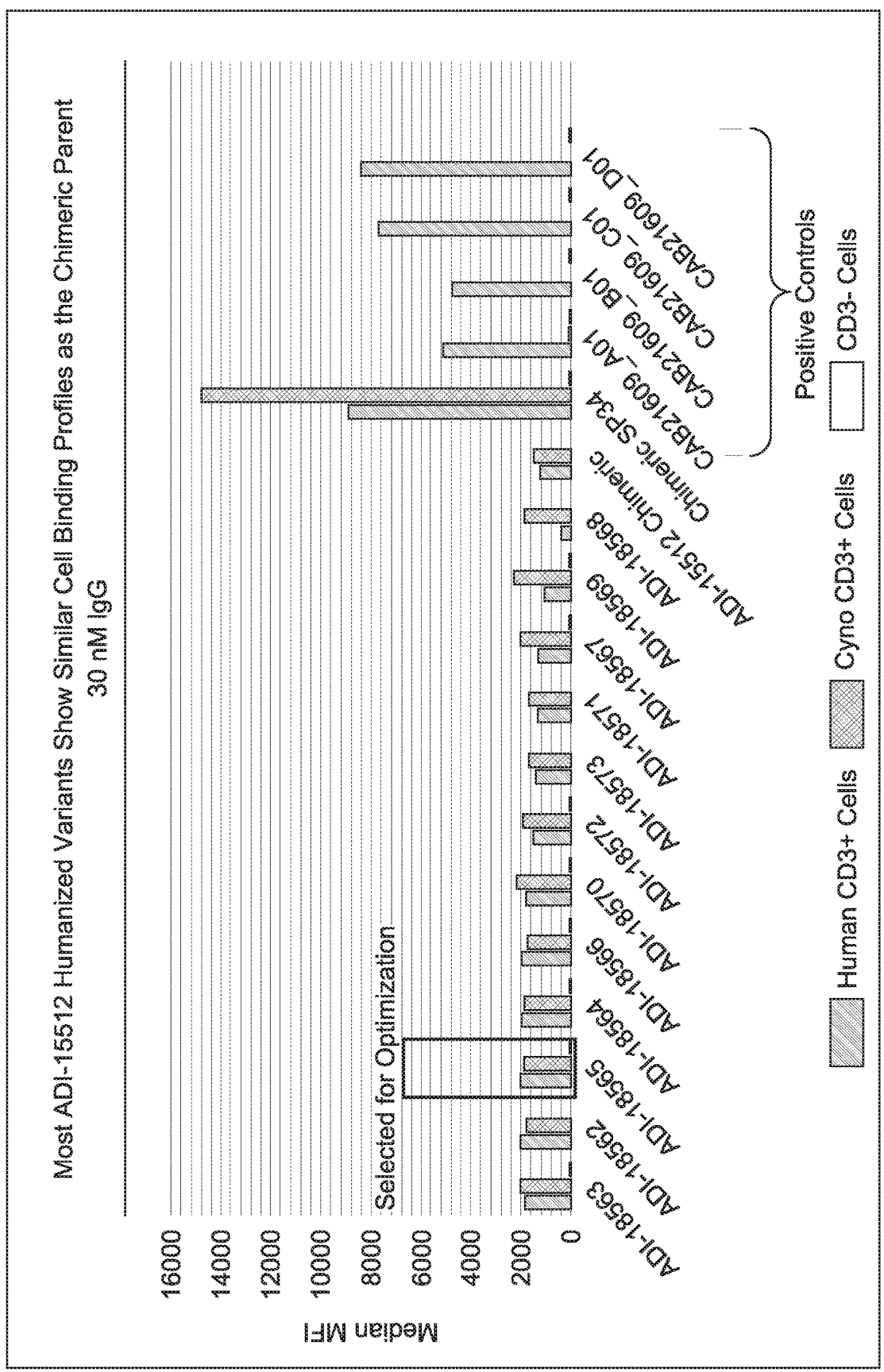
Figure 10C:
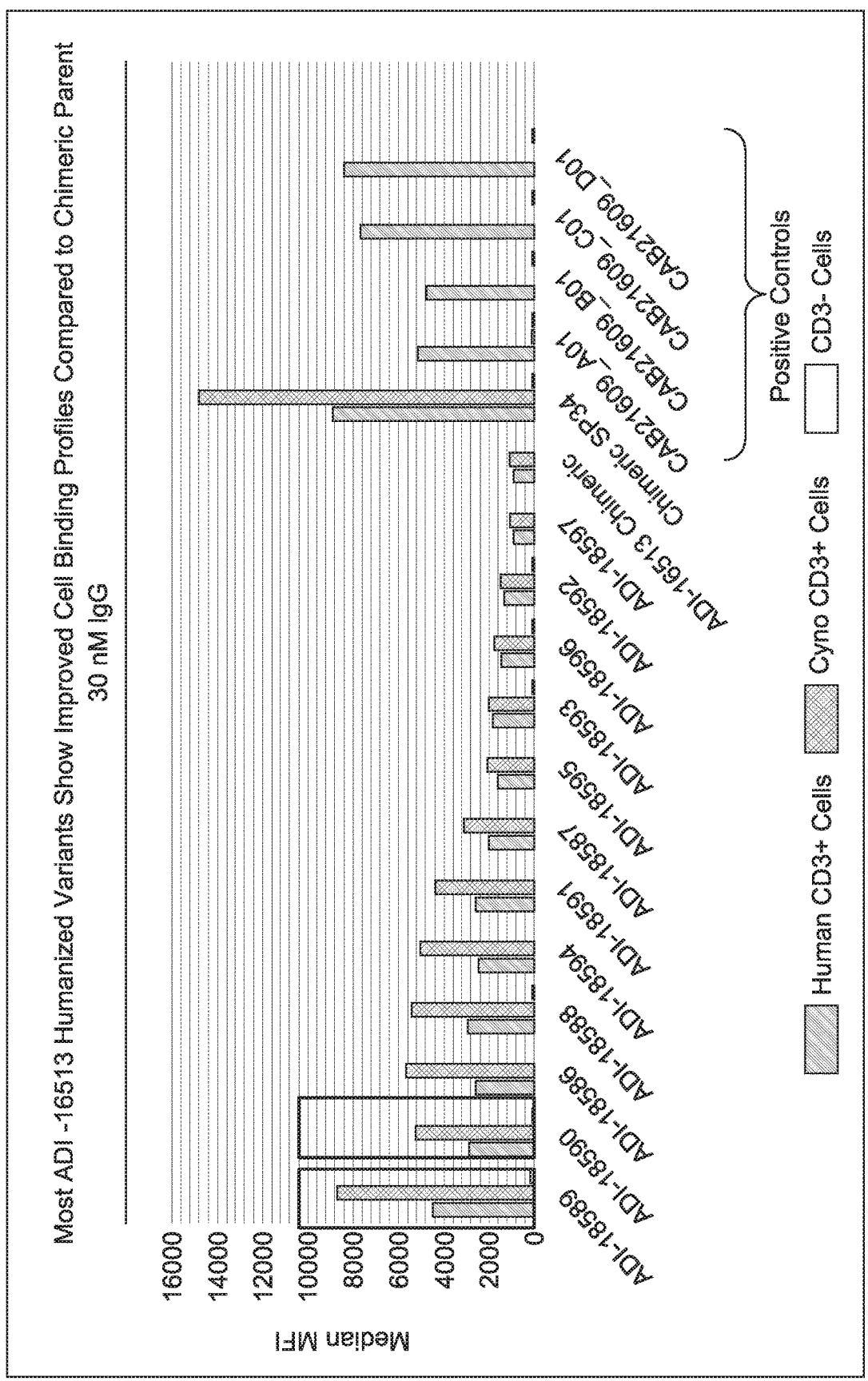
Figure 10D:
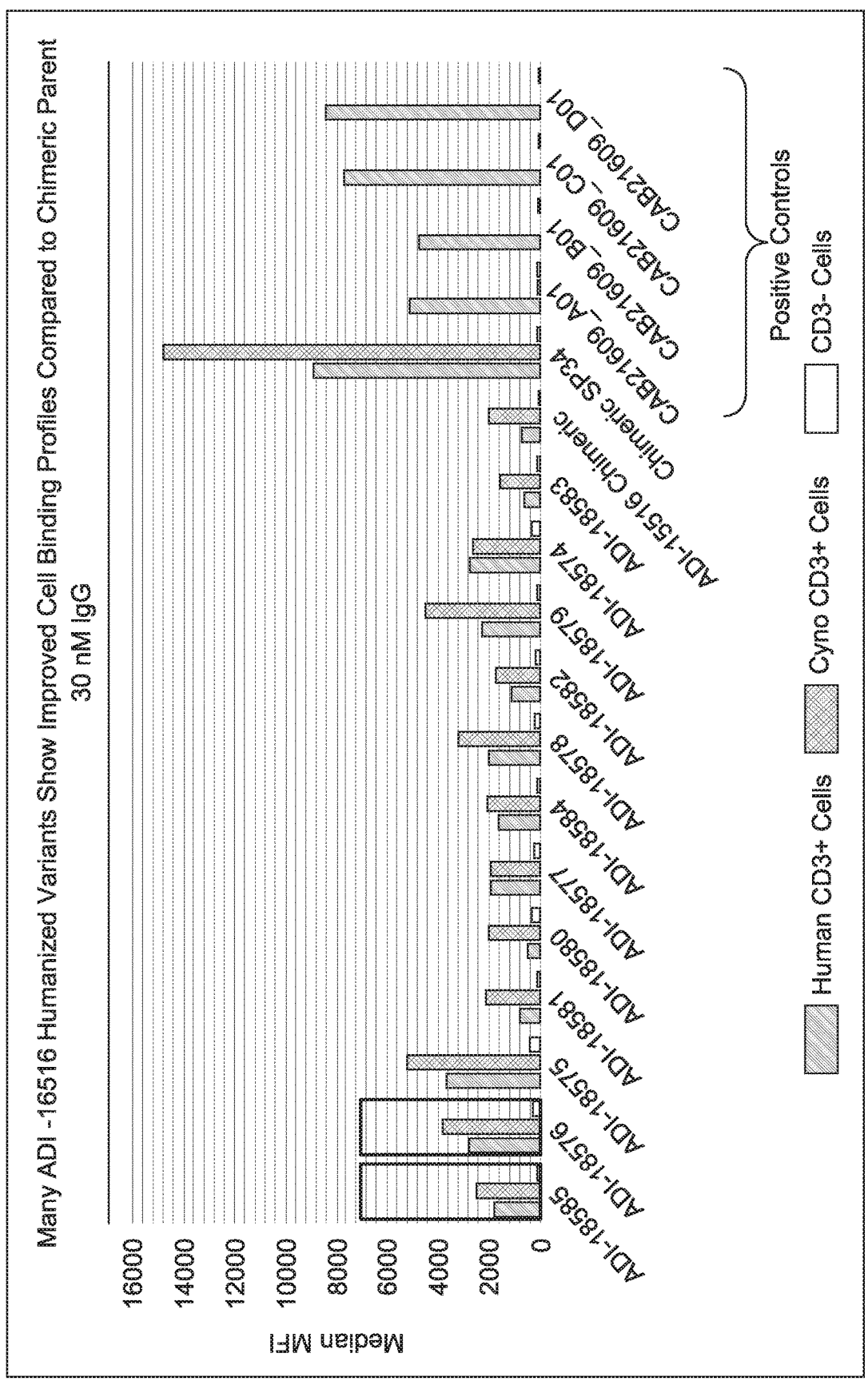
Figure 11A:
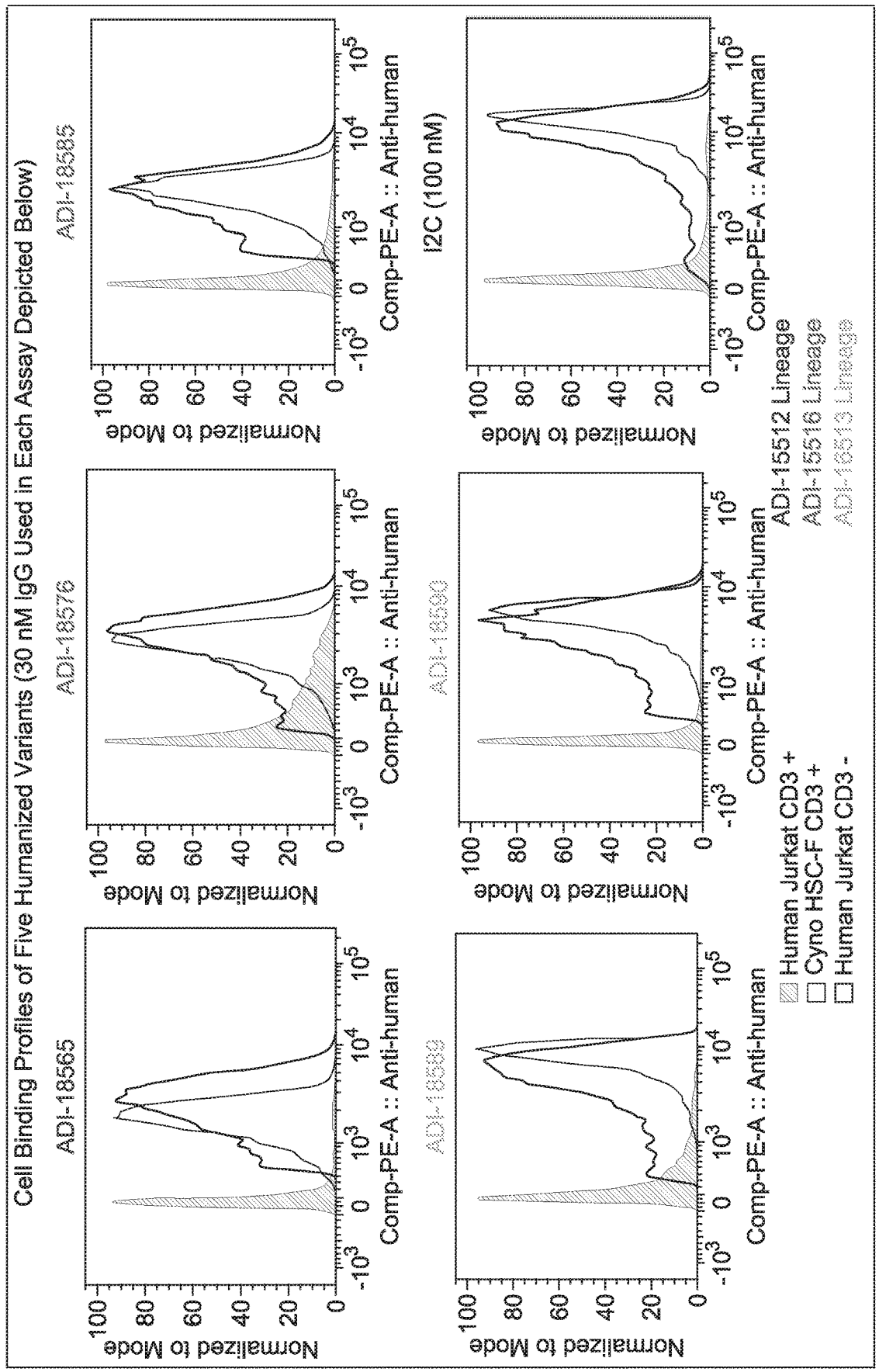
FIGS. 11A-11C show exemplary cell binding profiles of five humanized variants (A), exemplary data showing five humanized variants bind as well or better to CD3+ cells compared to parental chimeras (B), and exemplary data showing humanized variants show increased FB binding responses to CD3ε N-terminal peptide compared to chimeric parents N-terminal peptide binding response (C).
Figure 11B:
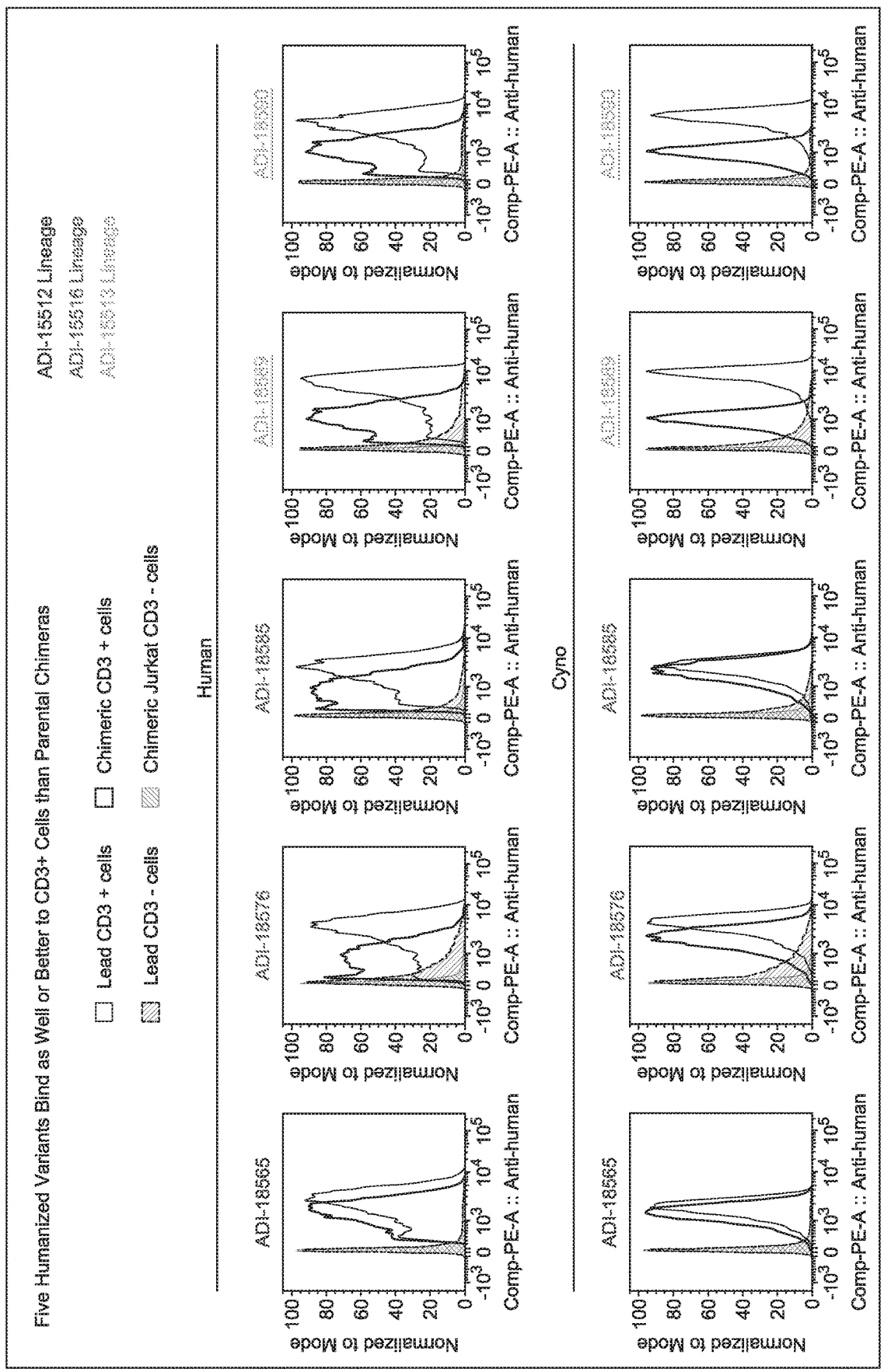
Figure 11C:
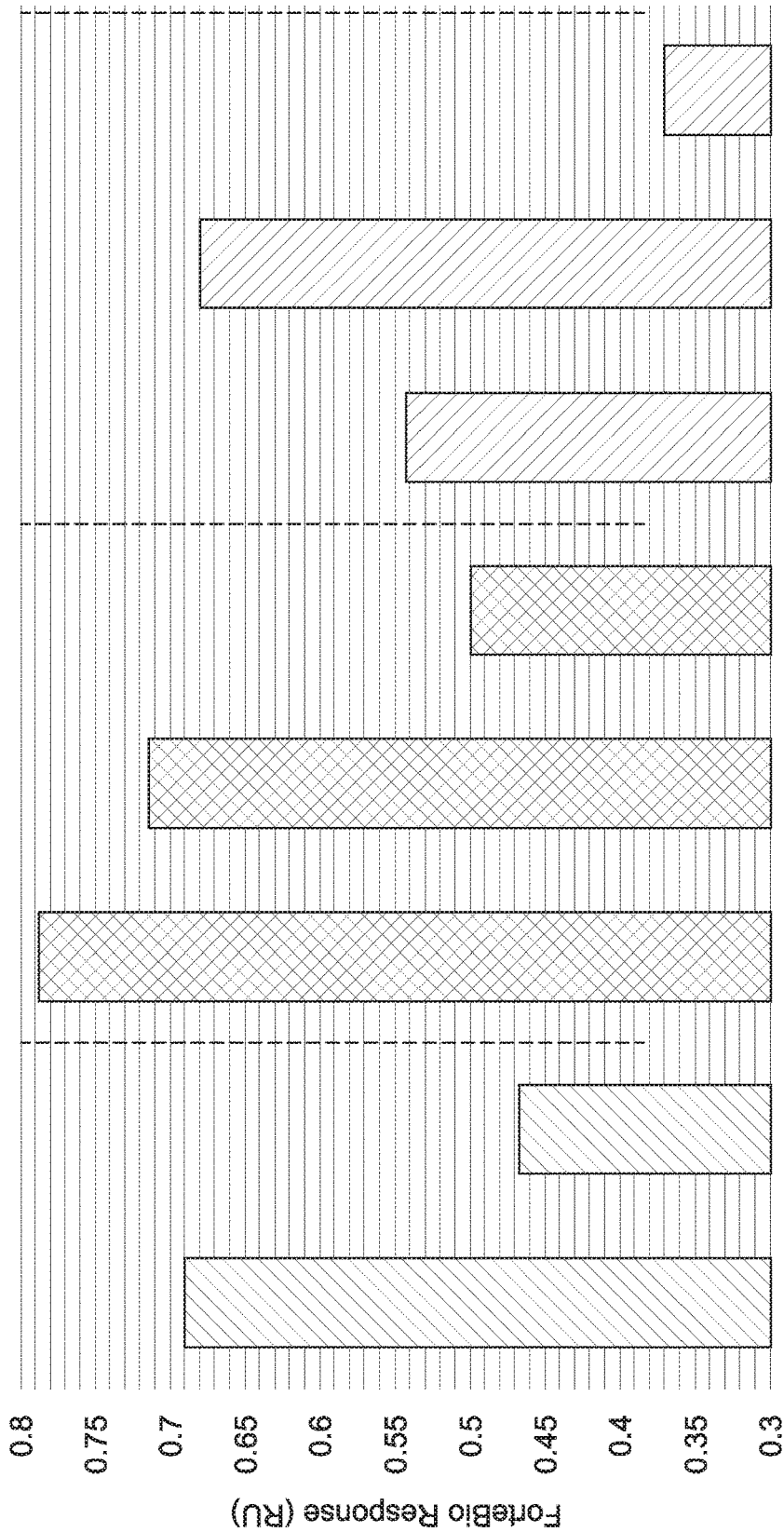

The three highest affinity CD3 binding clones (ADI-15512, ADH-15516, and ADI-16513; see, e.g., FIG. 9) were selected for humanization. In that effort, twelve humanized variants were generated for each clone (36 variants in total) and tested for cell binding activity (see FIG. 10A for sequence and germline information for each of these variants vs. the respective parents, ADI-15512, ADI-15516, and ADI-16513). Most of the humanized variants showed similar or improved cell binding profiles compared with the chimeric parents (see, e.g., FIGS. 10B, 10C, and 10D, for comparison of cell binding profiles of humanized variants and chimeric parents of ADI-15512, ADI-15516, and ADI-16513, respectively).

Figure 12A:
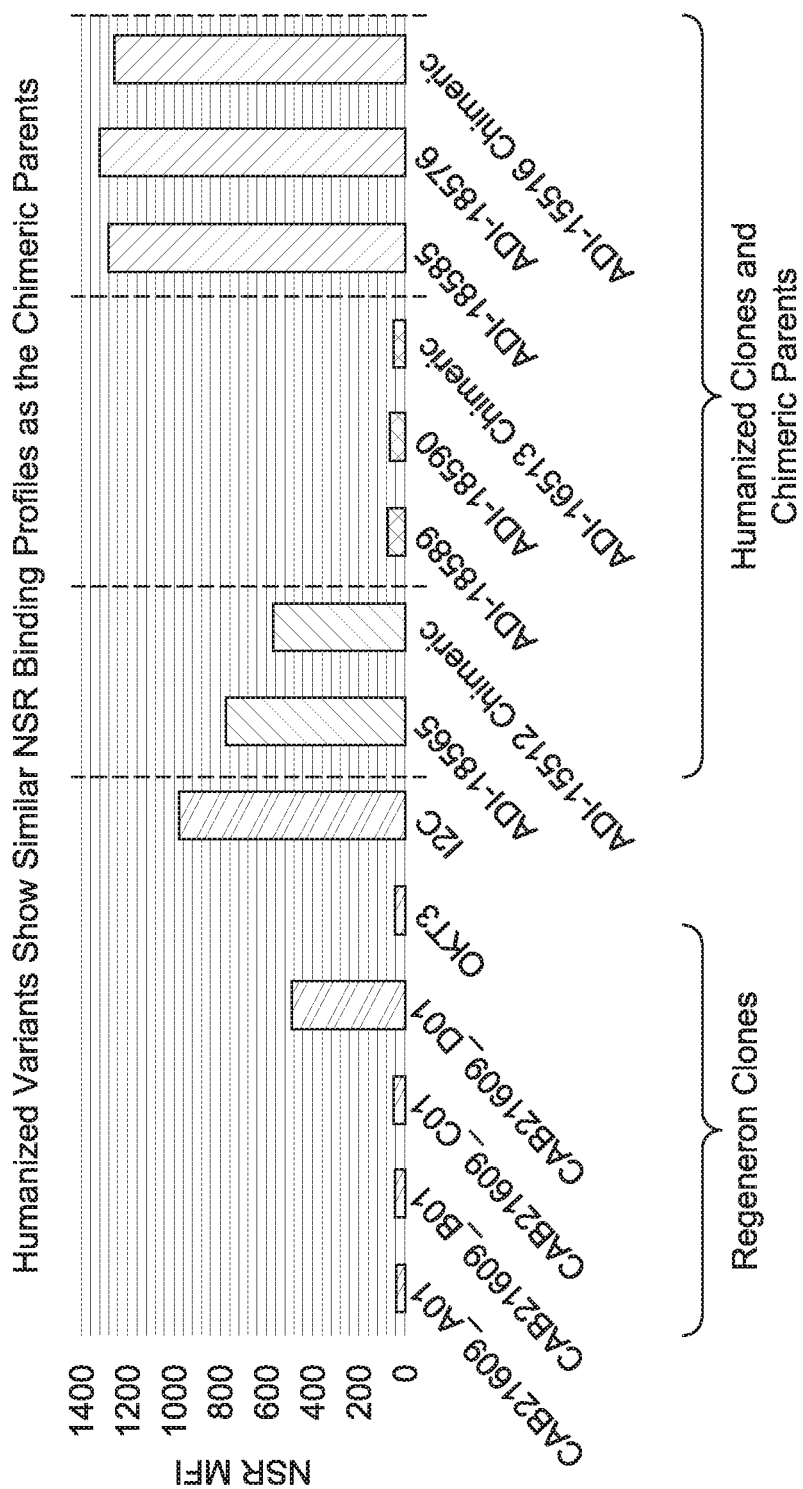
FIGS. 12A-12B show exemplary data of humanized variants that show similar NSR binding profiles as the chimeric parents (A), and an exemplary developability profile (B).
Figure 12B:
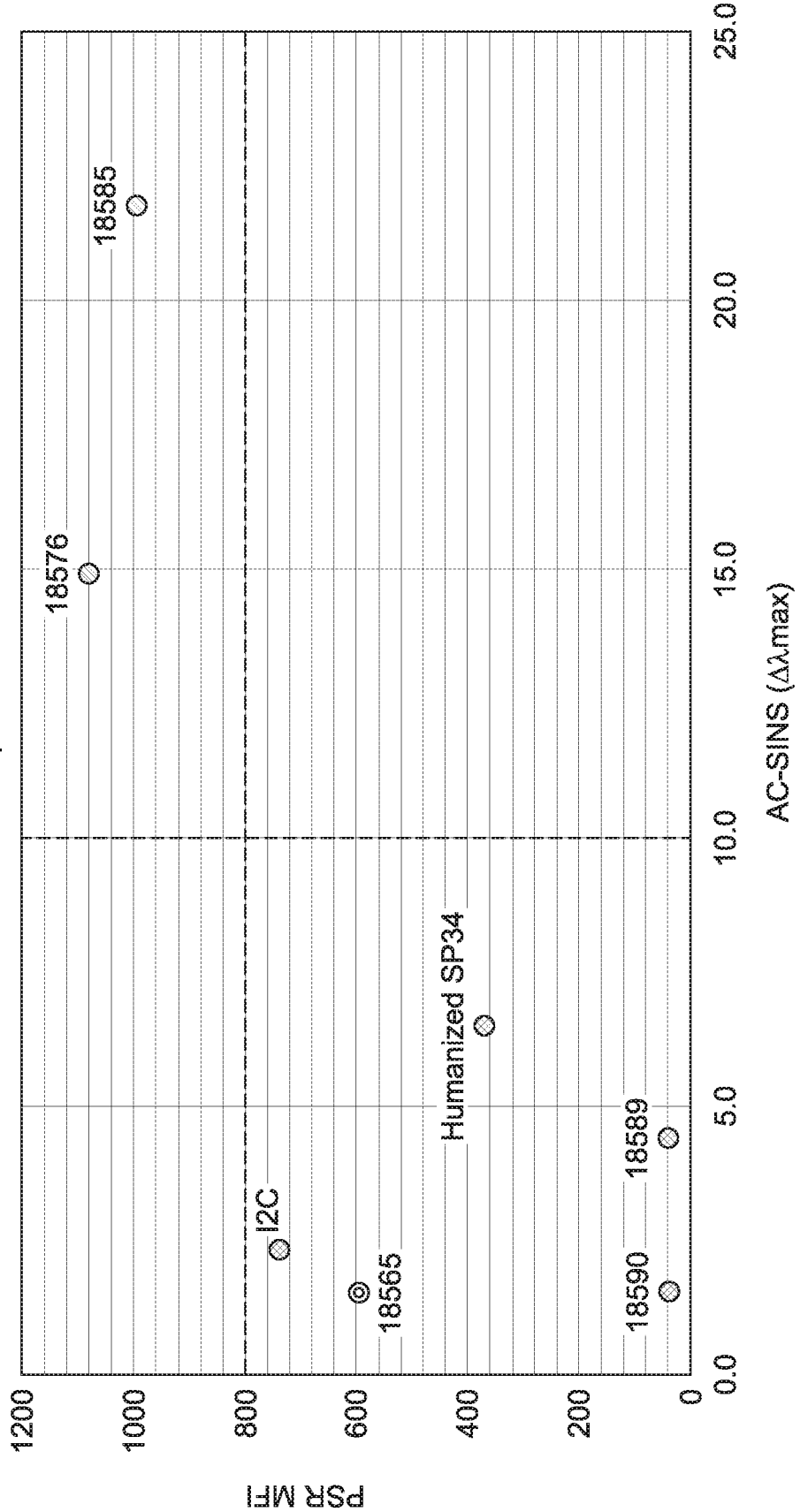

Six of the humanized variants, ADI-18565, ADI-18576, ADI-18585, ADI-18589, and ADI-18590, were selected for affinity-based optimization based on their binding (see, e.g., FIGS. 10B, 10C, 10D, 11A, 11B, 11C, and 13) and polyreactivity profiles (see, e.g., FIGS. 12A and 12B). Affinity maturation was performed by generating libraries of antibody variants containing mutations in the VH and/or VL of each of the afore-mentioned clones, and selecting for improved binding by flow cytometry (see, e.g., WO 2009/036379; WO 2010/105256; WO 2012/009569; Xu et al., *Protein Eng Des Sel*. Vol. 26(10), pages 663-670 (2013) doi: 10.1093/protein/gzt047; and Sivasubramanian et al., *MAbs*. Vol. 9(1), pages 29-42 (2017) doi: 10.1080/19420862.2016.1246096).

Optimization Cycle 1: VH and VK Mutagenesis.

Figure 14:
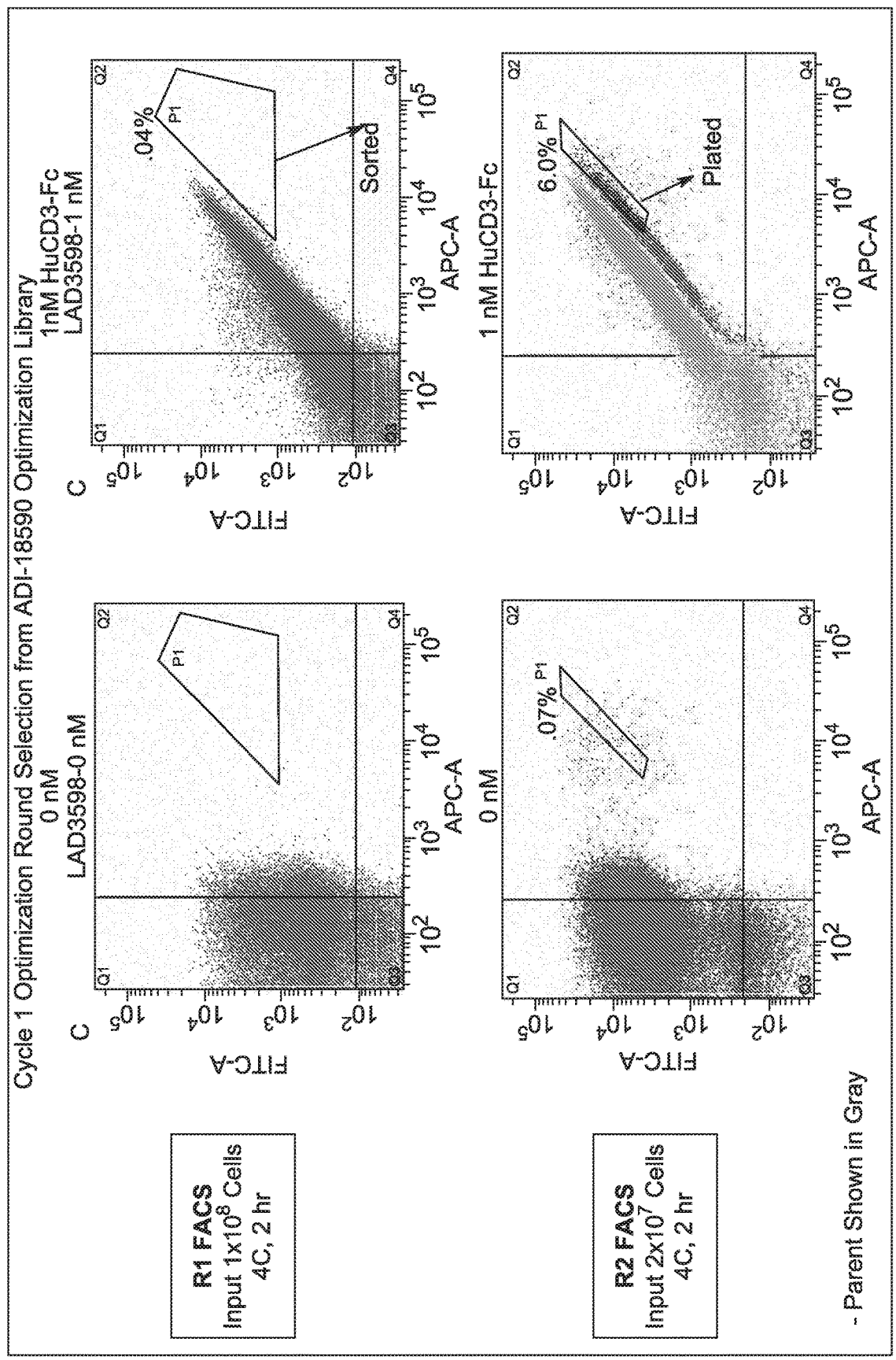
FIG. 14 shows an exemplary FACS experiment showing cycle 1 optimization round selection from ADI-18590 optimization library.

For the first optimization cycle ("Cycle 1"), error-prone PCR was performed on both of the antibody VH and VL genes using standard methods and subsequently transformed into yeast using homologous recombination. Briefly, a diversified antibody library was created by introducing stochastic diversity (using standard molecular cloning error-prone PCR techniques) across the heavy and light chain variable domain regions of each antibody. This resulted in a library of roughly $10^8$ in size that were ready for selection to enrich for progeny with improved affinity. Selection pressures included human (Hu) and cynomolgus (Cy) CD3εδ heterodimeric Fc fusion monomer (hereafter Hu CD3δ6 Fc and Cy CD3εδ Fc, respectively; see FIG. 18) antigen titration, biotinylated Hu CD3ε N-terminal peptide (CD3εN27 and CD3εN13 having the sequences described in Materials and Methods) antigen titration, and parental antibody Fab competition. Flow cytometry (FACS) methodology was employed to visualize and select, using standard techniques, the desired population to carry forward into additional selection rounds (see, e.g., Chao et al. Nature Protocols, 2006, WO 2009/036379; WO 2010/105256; WO 2012/009569; Xu et al., *Protein Eng Des Sel*. Vol. 26(10), pages 663-670 (2013) doi: 10.1093/protein/gzt047; and Sivasubramanian et al., *MAbs*. Vol. 9(1), pages 29-42 (2017) doi: 10.1080/19420862.2016.1246096). After several rounds of enrichment, yeast were plated to obtain colonies representing monoclonal antibody isolates, which were then sequenced by standard Sanger methodology, produced, and characterized as in the humanization selection described above (see, e.g., FIG. 14 for a depiction of an exemplary FACS experiment and the resulting output population). Antibodies identified from the output with improved cell binding affinities were subject to a second cycle of mutagenesis and selection using similar methods as those described above.

Optimization Cycle 2; HC×LC Chain Shuffle.

Figure 15:
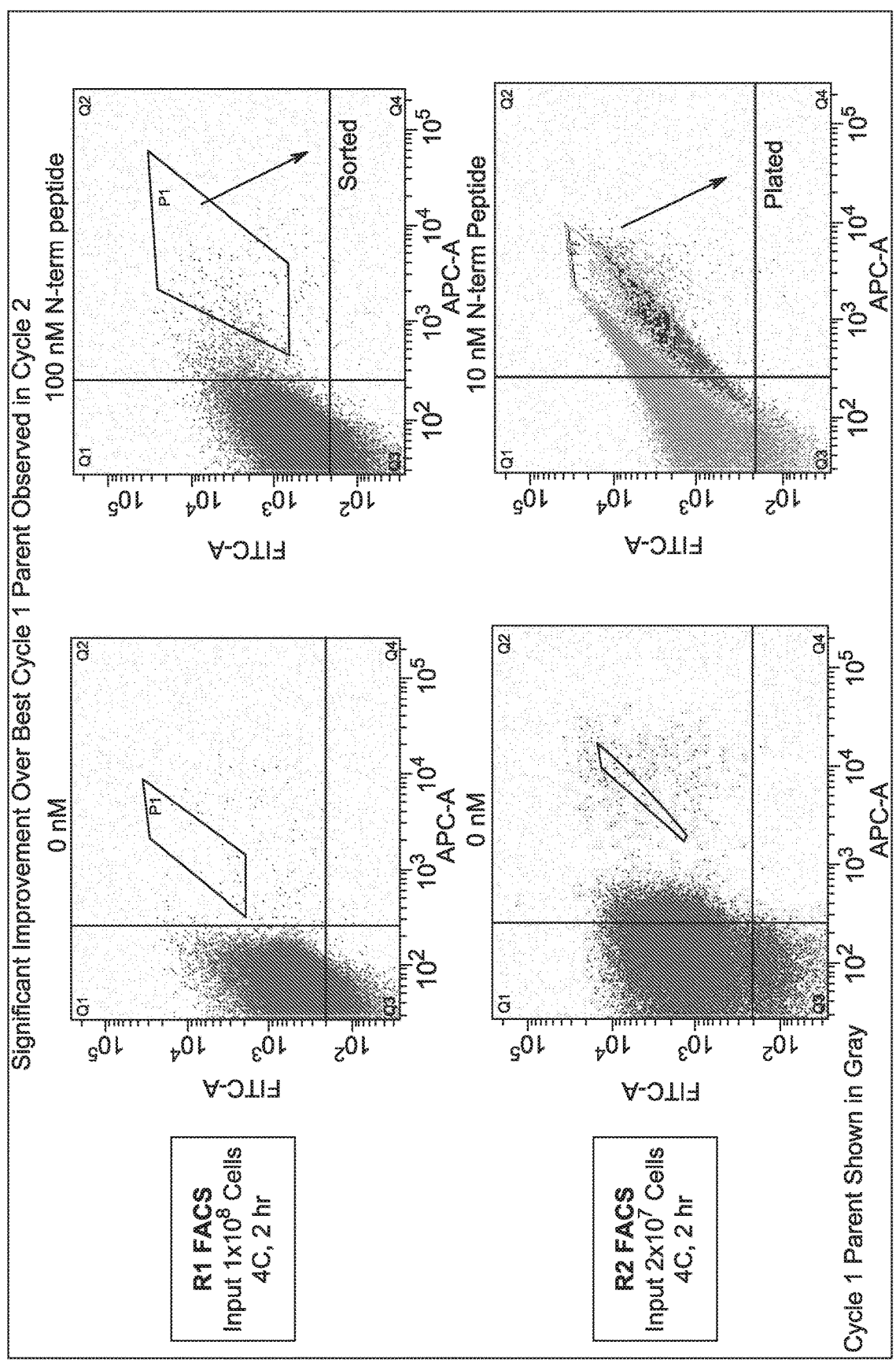
FIG. 15 shows an exemplary FACS experiment showing results of a second effort to affinity-mature human/cyno cross-reactive antibodies derived from ADI-18589 and ADI-18590 lineages.
Figure 16:
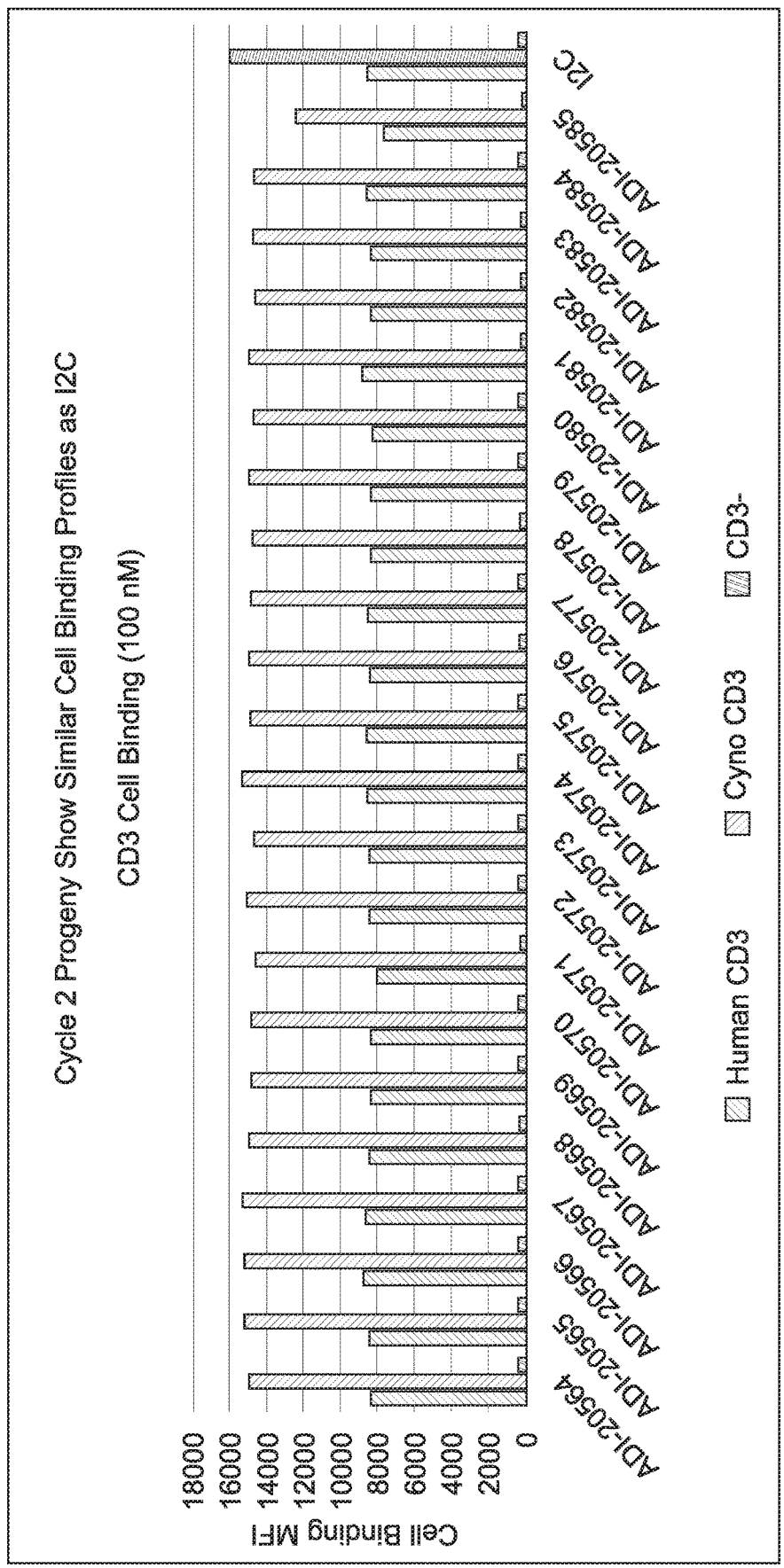
FIG. 16 shows an exemplary graph demonstrating cycle 2 progeny show high affinity binding to cell surface CD3.

A second effort was undertaken to affinity-mature human/cyno cross-reactive antibodies derived from the ADI-18589 and 18590 lineages ("Cycle 2"; see, e.g., FIG. 15 for exemplary FACS experiment and resulting output population). Briefly, antibody HC and LC were shuffled to create a combinatorial library in yeast for each of the starting parent antibodies and the library was subjected to rounds of affinity pressure similar to Cycle 1. Terminal round output monoclonal antibodies were sequenced, produced, and characterized. All of the clones selected from the second cycle of affinity maturation showed high affinity binding to cell-surface CD3 (see FIG. 16), and had mutations in both the VH and VK regions relative to the parent clones (i.e., ADI-18589 and ADI-18590). Each exhibited Fab monovalent affinities to Hu CD3εδ Fc in the 13-142 nM $K_D$ range and Fab monovalent affinities to Cy CD3εδ Fc in the 15-109 nM $K_D$ range as determined by ForteBio Octet BLI measurement.

Figure 17:
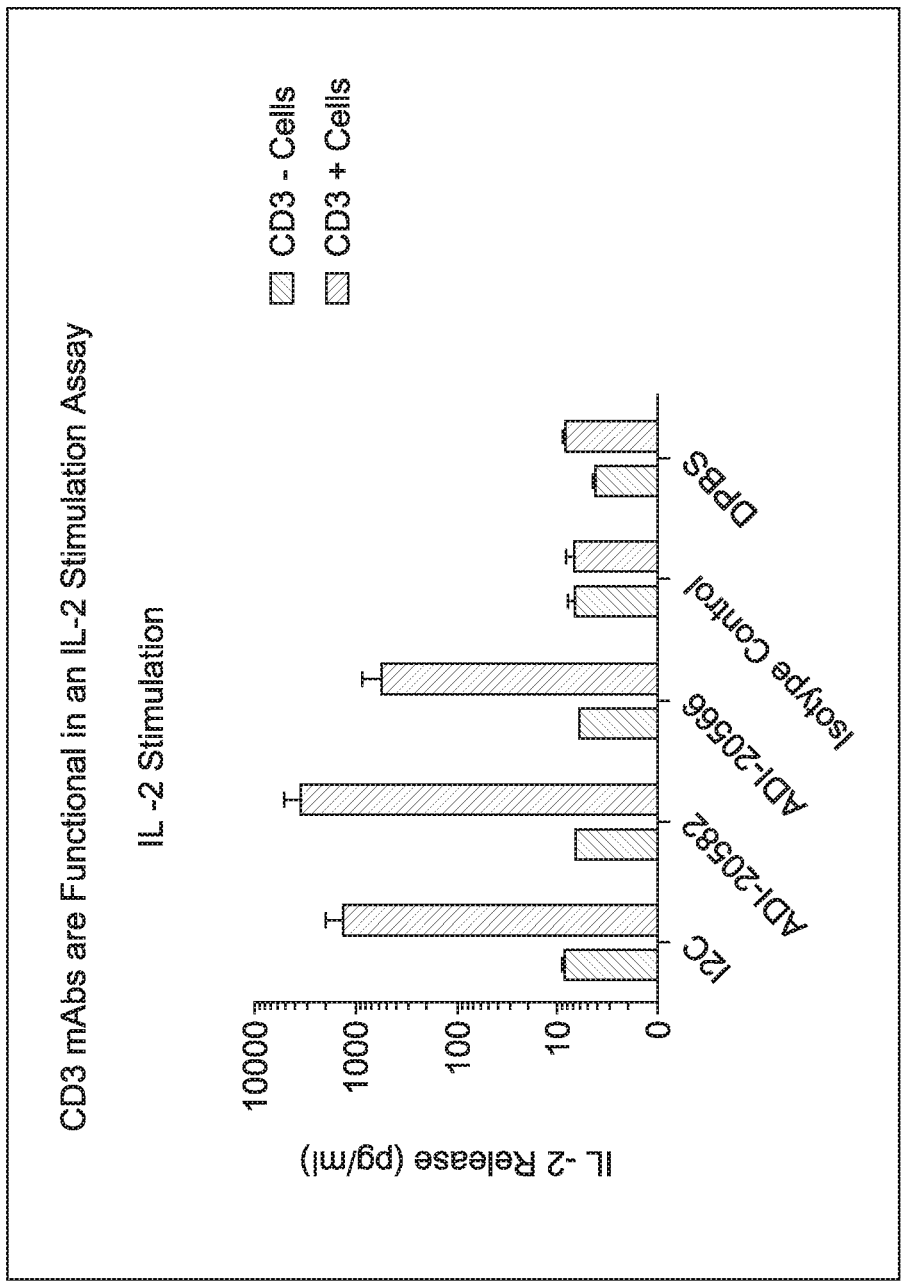
FIG. 17 shows an exemplary graph showing CD3 binders elicit robust IL-2 release by CD3+ Jurkat T-cells relative to CD3− control T-cells, at a level meeting or exceeding that observed with the I2C control.

In order to ascertain the functional activity of the CD3 binders, a T-cell based IL-2 secretion assay—a measure of T-cell activation—was performed using two exemplary CD3 binders of the invention (ADI-20582 and ADI-20566) in comparison with I2C, an isotype control, and buffer alone (DPBS). The results, depicted in FIG. 17, demonstrate that the exemplary CD3 binders elicited robust IL-2 release by CD3+ Jurkat T-cells relative to CD3-control T-cells, at a level meeting or exceeding that observed with the I2C control. Accordingly, CD3 binders of the present invention elicit potent T-cell activation.

Optimization Cycle 3; CDR H3 Mutagenesis and Rational Combination.

Figure 20:
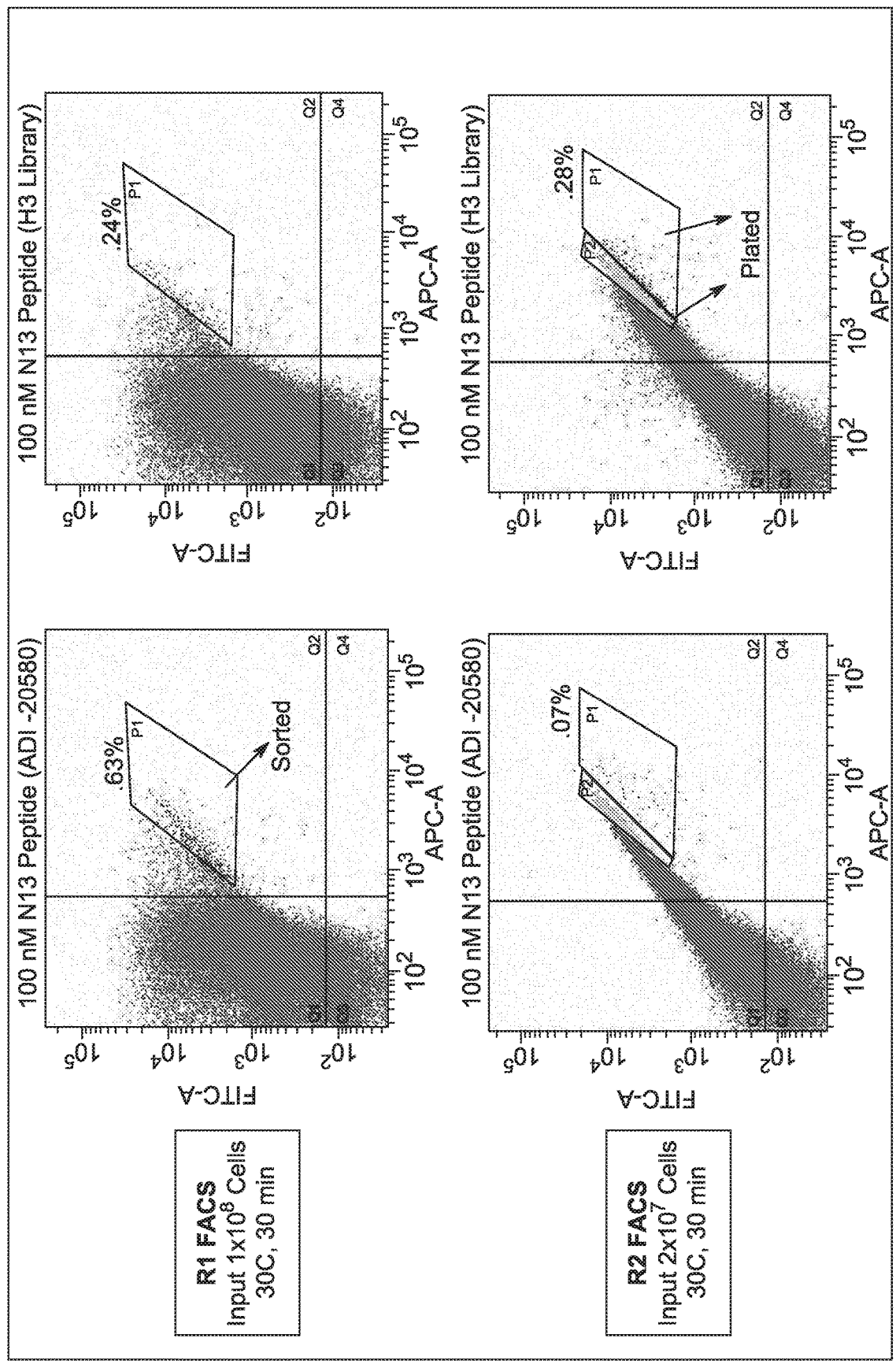
FIG. 20 shows a depiction of exemplary FACS results for a library subjected to two rounds of affinity pressure using titration of the CD3εN13 peptide.
Figure 21:
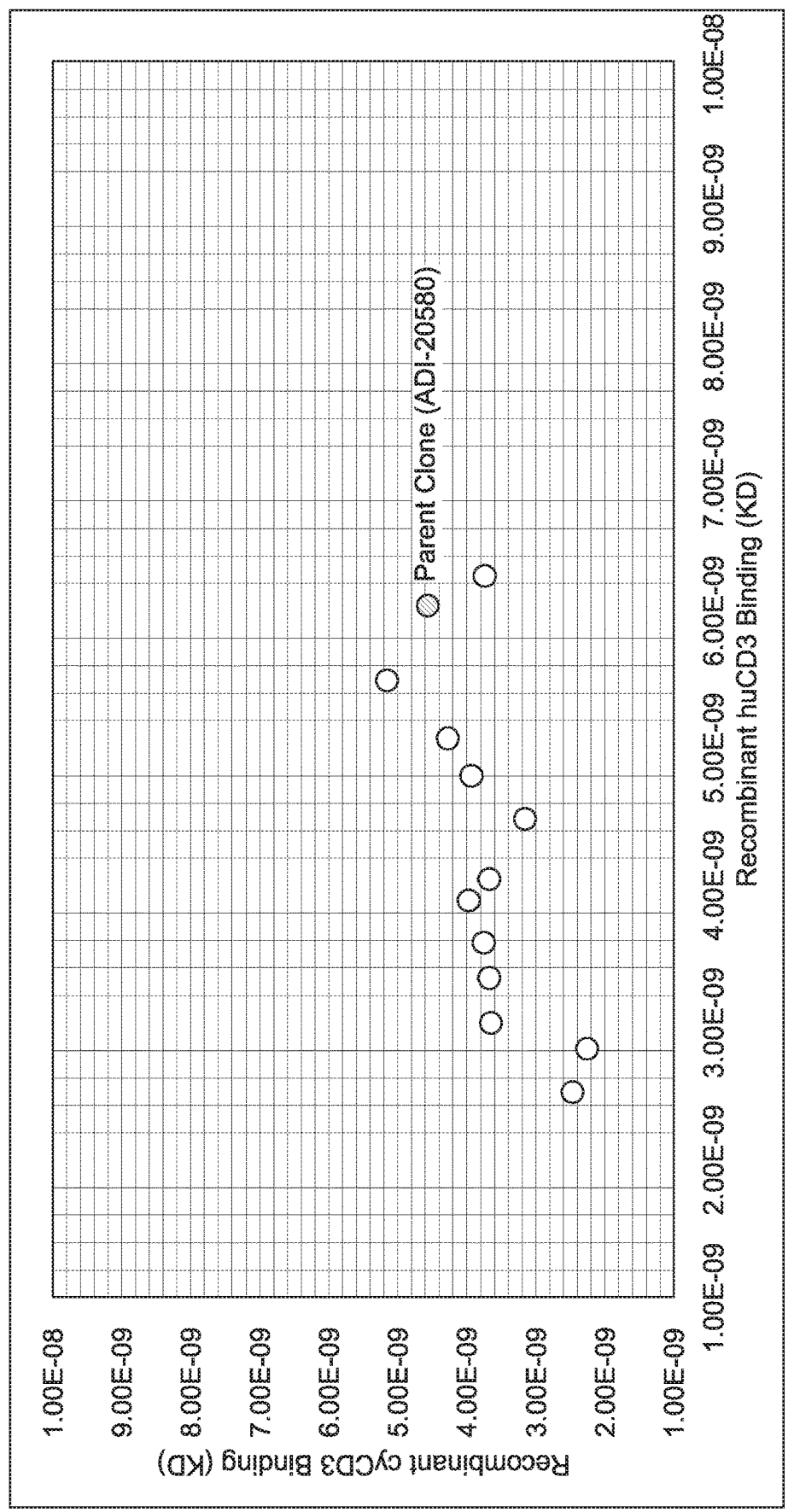
FIG. 21 shows an exemplary graph showing several clones have improved binding affinity and cell staining compared to ADI-20580.

Subsequently, a single clone (ADI-20580) identified in the Cycle 2 optimization effort was selected for further optimization error ("Cycle 3") via H3 mutagenesis. H3 mutagenesis libraries were generated using standard oligo-based methods (e.g., NNK-based methods) and transformed into *Saccharomyces cerevisiae* using homologous recombination (see, e.g., Lee et al, *J. Mol. Biol*. Vol. 340, pages 1073-1093 (2004); WO 2009/036379; WO 2010/105256; and WO 2012/009569). Briefly, mutagenic oligonucleotides encoding site saturation (NNK nucleotide) mutagenesis at every pair of residues in combinatorial fashion were used to construct a library of theoretical diversity exceeding $2.6 \times 10^4$ (FIG. 19). The library was subjected to two rounds of affinity pressure using titration of the CD3εN13 peptide from 100-10 nM by flow cytometry generally as described above (see FIG. 20 for depiction of FACS results). Selected progeny were sequenced, produced, and characterized. Mutations observed in ADI-21970 and ADI-21961 and were rationally combined on the basis of observed affinity improvement. The mutation observed in ADI-21960 was also included based on H3 repeat frequency to generate rational, combinatorially combined variants based on mutations observed in five selected clones (FIG. 22). Several clones showed improved binding affinity and cell staining compared to ADI-20580, while also showing a decrease in polyspecific reactivity (PSR) score (see FIGS. 21 and 22). ADI-21978 was chosen for scFv conversion and rational engineering of potential sequence degradation motifs.

Optimization Cycle 4; Rational Mutagenesis of Potential Degradation Sequence Motifs.

Figure 23B:
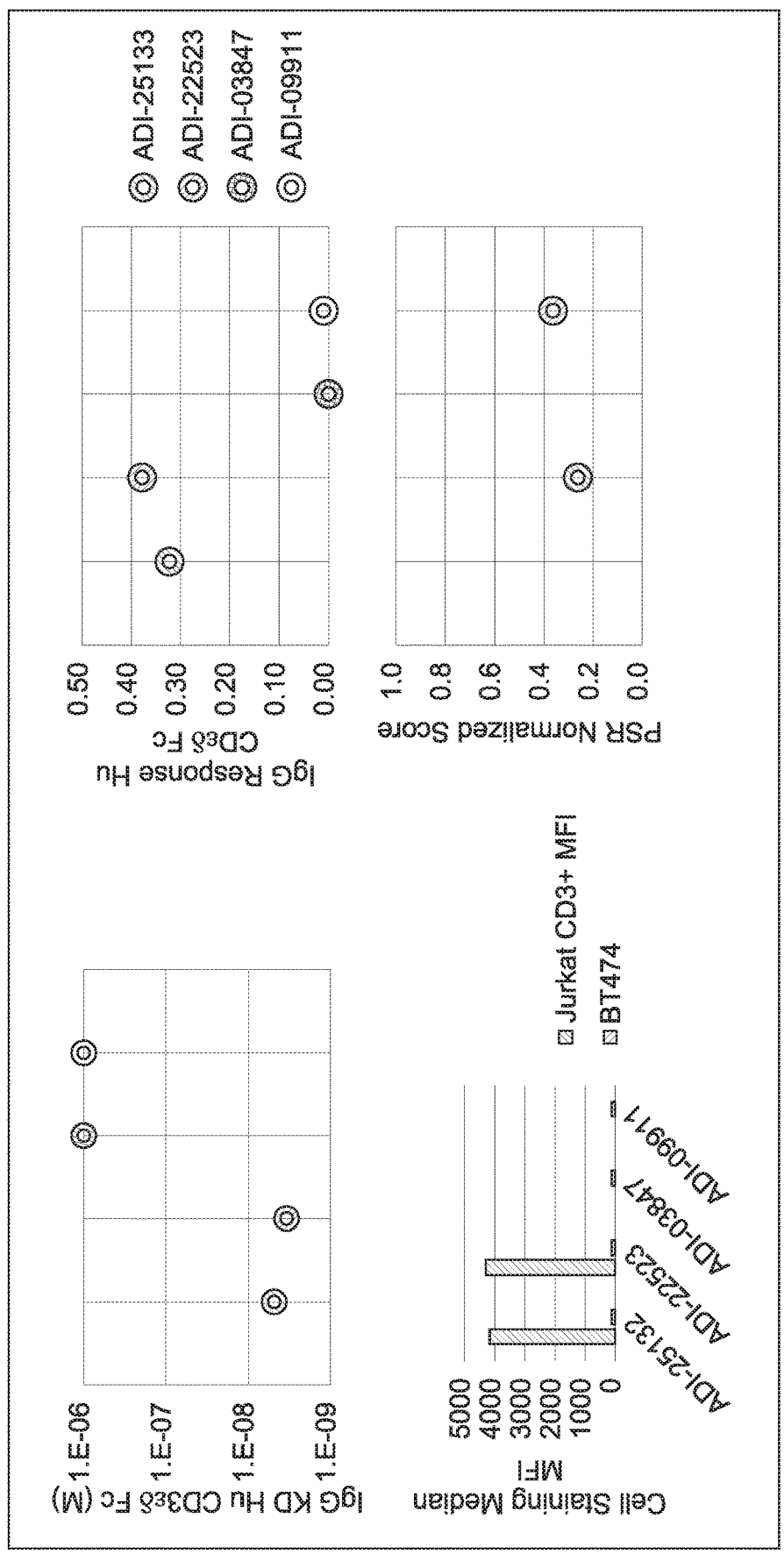

ADI-21978 was observed potential sequence degradation motifs NG (Asn-Gly) and DP (Asp-Pro) in CDR H2, DG (Asp-Gly) in CDR H3, and NS (Asn-Ser) in CDR L1. These sites were rationally mutated to according to the following substitutions: NG→EG (Glu-Gly) or NA (Asn-Ala), DP→QP (Gln-Pro) or DA (Asp-Ala), DG→EG or DA, and NS→ES (Glu-Ser) or NA. The four sites were combined in a combinatorial matrix and the variant IgG were produced and characterized. Individual site substitutions were well tolerated, particularly mutations of the second position to Ala (i.e. NG→NA, DG→DA, etc.). Comparison of ADI-22523 (all four sequence liability sites) to individual VH Ala substitutions showed a <2-fold reduction in monovalent (Fab) affinity for Cy CD3εδ and resolution of all four sites had a modest effect on avid (IgG) affinity for Hu CD3εδ (see FIGS. 23A and 23B). The resulting quadruple Ala variant ADI-25133 (ADI-26906) was used to compose a panel of bispecifics and for further CDR H3 mutagenesis.

Additionally, ADI-26906 was also converted to an scFv format using the same method as described for ADI-21978 and ADI-21952 and, as with those other scFv conversions, cell binding analysis revealed that conversion was well-tolerated. Optimized scFvs were tested for developability and thermostability.

Optimization Cycle 5; CDR H3 Mutagenesis Focused on DG Sequence Motif.

ADI-21978 (ADI-22523) was diversified by site-saturation (NNK) mutagenesis targeting the degradation motif DG in CDR H3. In brief, every residue of the H3 was mutated in combination with the first or second position of the Asp-Gly site (FIG. 24). A single round of FACS selection using the CD3εN13 peptide at 100 nM and 10 nM was conducted and the output sequenced, produced, and characterized. Only mutation of the Gly residues of the Asp-Gly motif produced binders, and all progeny showed some reduction in binding affinity relative to the parent (ADI-21978 (ADI-22523)).

Cycle 6; Affinity Modulation by Rational Combination.

Figure 25A:
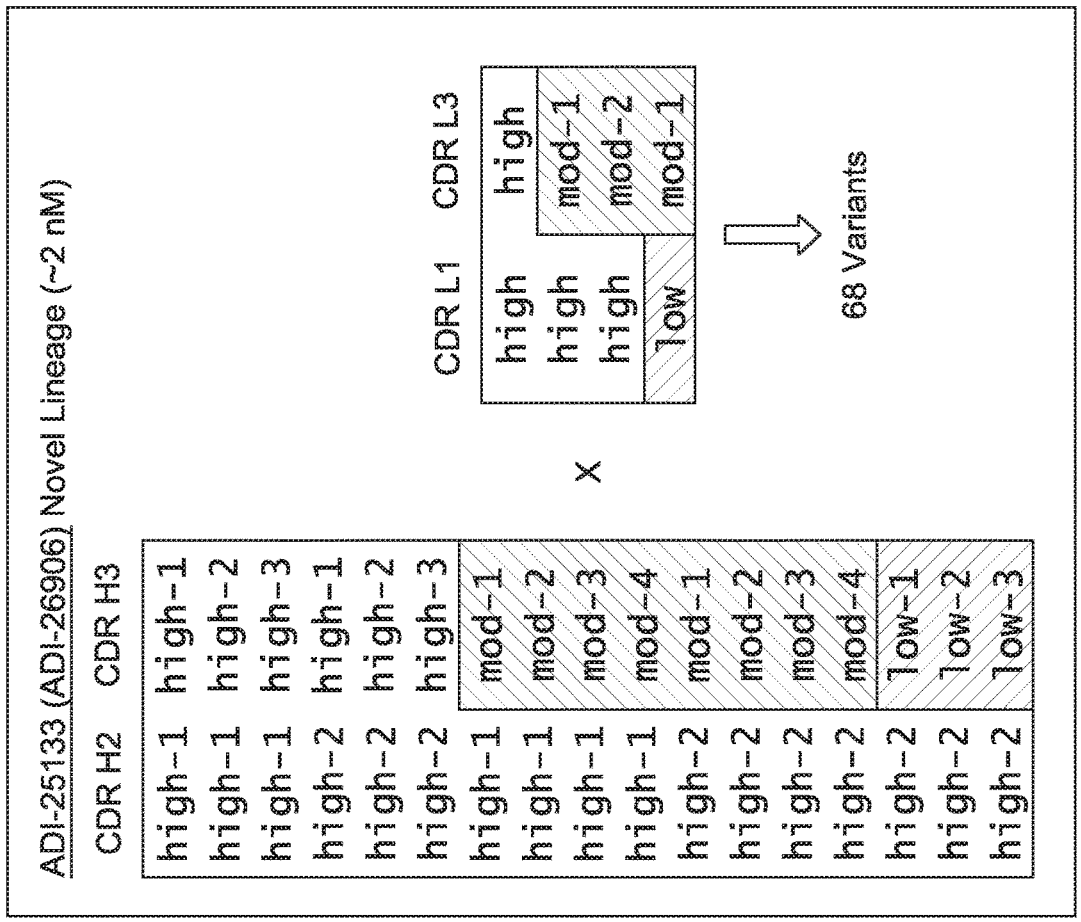
FIGS. 25A-25D show exemplary rational variegation of ADI-25133 by a matrix of CDR H2 and H3 sequences known to affect affinity with CDR L1 and L3 sequences known to affect affinity to yield a panel of 68 combinations (A), exemplary data showing monovalent Fab binding affinity spanned a range of nM-uM and correlated with cell binding median MFI at 100 nM IgG test concentration (B-C), and exemplary data showing Fab showed low IFNγ production by PBMC at 10 nM, but undetectable IFNγ production at 0.3 nM concentration (D).
Figure 25B:
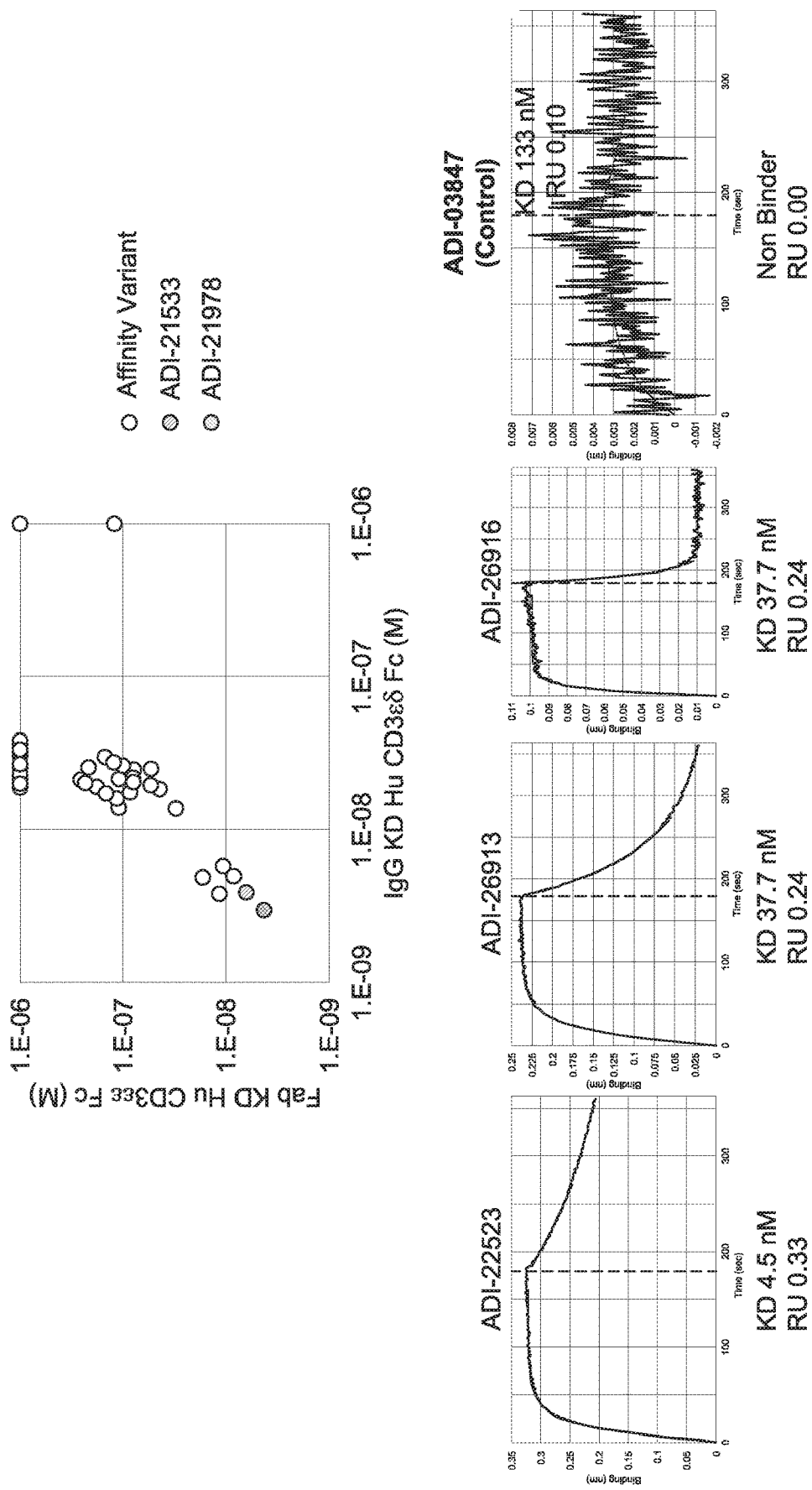
Figure 25C:
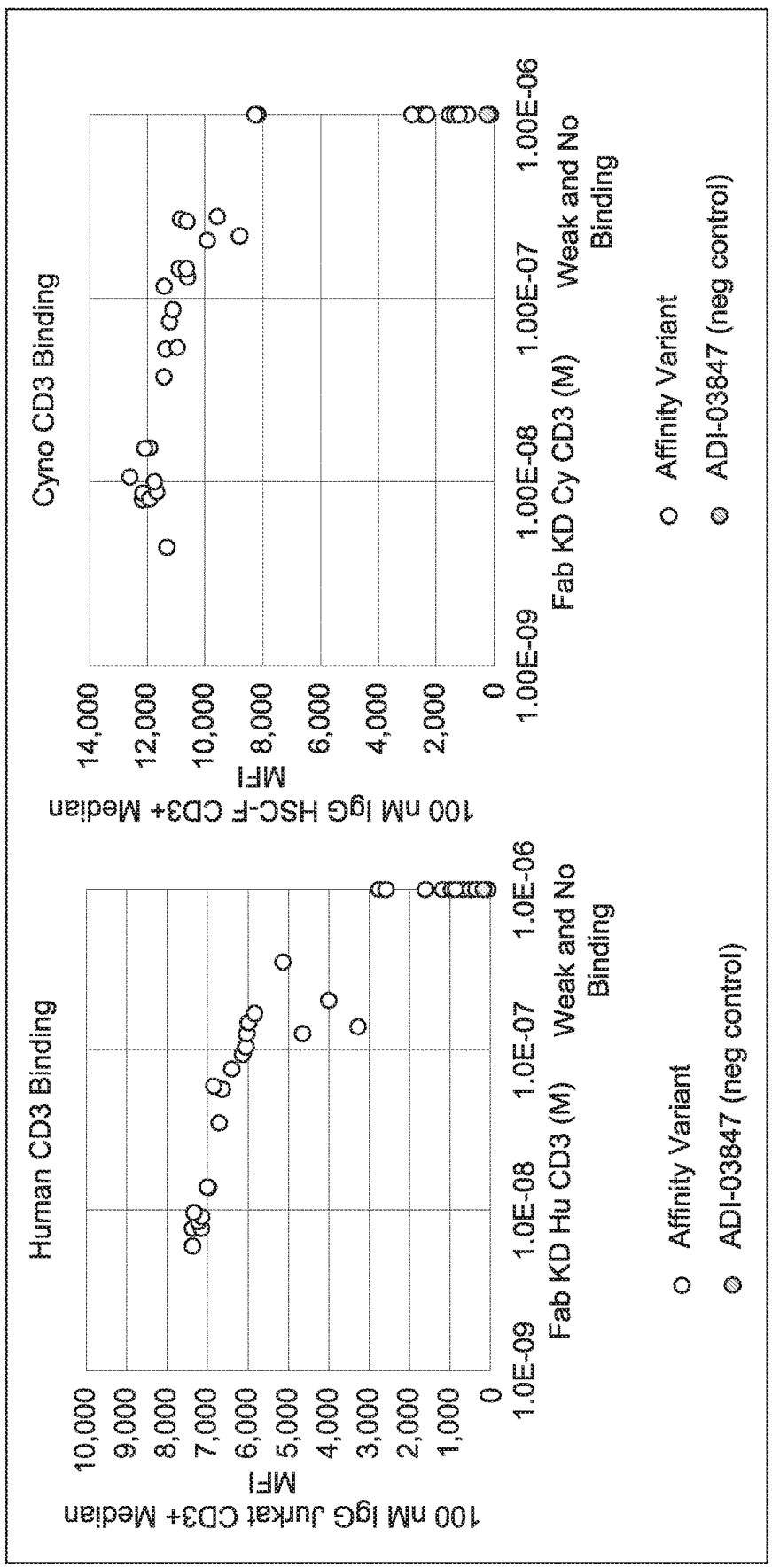

ADI-25133 (ADI-26906) was rationally variegated by a matrix of CDR H2 and H3 sequences known to affect affinity with CDR L1 and L3 sequences known to affect affinity to yield a panel of 68 combinations (FIG. 25A). The resulting sequence-confirmed antibodies were produced in yeast and characterized for recombinant antigen and cell binding. Monovalent Fab binding affinity spanned a range of nM-µM and correlated with cell binding median MFI at 100 nM IgG test concentration (FIGS. 25B and 25C). IFNγ production from PBMC was measured for both IgG and Fab formats, using two donors.

Clones derived from Cycles 5 and 6 were then tested for their ability to elicit T-cell stimulation and activation as deduced by measured cytokine levels as described below:

Cell Lines/Primary Human Cells.

Frozen human peripheral blood mononuclear cells (PBMC) were purchased from AllCells Inc. (Alameda, Calif.)

Fresh peripheral blood mononuclear cells were purified from human whole blood from Scripps blood bank by Ficoll-Hypaque density gradient centrifugation.

Cell Culture Materials.

PBMC were cultured in RPMI-10% FBS consisted of RPMI-1640 serum-free medium supplemented with 10% fetal bovine serum (Hyclone FBS; catalog number SH30071.031R, GE Healthcare, Logan, Utah), L-glutamine (catalog number 11875-093, ThermoFisher, Waltham, Mass.), 1% penicillin/streptomycin (catalog number 15070-063, ThermoFisher), 1 mM sodium pyruvate (catalog number 11360-070, ThermoFisher), 10 mM 4-(2-hydroxyethyl)-1-piperazineethanesulfonic acid (HEPES; catalog number 15630080, ThermoFisher), and 1× non-essential amino acid (catalog number 11140-50, ThermoFisher).

Previously frozen PBMC were quick thawed in 37° C. water bath and added to pre-warmed RPMI-10% FBS media. Cells were pelleted at 300×g, re-suspended in pre-warmed media and counted before use.

Determination of Anti-CD3 Clone Activation of T Cells in PBMCs in Soluble I2G1 Format and Fab Format Cell Stimulation Procedure Provided anti-CD3 IgG1 or anti-CD3 Fab were diluted in RPMI-10% FBS media to 2× final concentration (10 nM and 0.3 nM). Fifty microliters of 2× final concentration antibodies and 50 µL of donor PBMC at 2×10$^5$ cells/well were added to each well. Unstimulated control has RPMI-10% FBS media only, and positive control clone ADI-22523 and negative control ADI-03847 were also included in separate wells. Plates were incubated at 37° C. for 48 hours supernatant was harvested for cytokine analysis.

Measurement of T Cell Activation by Supernatant Cytokine Levels

After 48 hours of incubation, supernatant was collected for cytokine analysis by MesoScale discovery interferon-gamma tissue culture kit according to manufacturer's instruction. Supernatant was analyzed without dilution. Standard curve using recombinant cytokine was included in each plate for calculation of cytokine level in pg/ml.

Data Analysis

Cytokine Measurement by MSD.

Interferon gamma concentration (pg ml$^{-1}$) in supernatant was extrapolated using standard curve generated in MesoScale Discovery WorkBench software. Interferon gamma concentrations are listed as pg/ml. Antibody affinity data (Fab, IgG) to human CD3εδ was provided and are listed as Molar. Data is provided in the immediately following table (Table 1):

TABLE 1

| ADI clone ID | A4560 0.3 nM Fab IFNg (pg ml$^{-1}$) | A4560 0.3 nM IgG1 IFNg (pg ml$^{-1}$) | A4560 10 nM Fab IFNg (pg ml$^{-1}$) | A4560 10 nM IgG1 IFNg (pg ml$^{-1}$) | D5801 0.3 nM Fab IFNg (pg ml$^{-1}$) | D5801 0.3 nM IgG1 IFNg (pg ml$^{-1}$) |
|---|---|---|---|---|---|---|
| ADI-03847 | 0 | 0 | 0 | 0 | 0 | 0 |
| ADI-22523 | 0 | 2293.197 | 148.0116 | 4687.913 | 0 | 8857.269 |
| ADI-23664 | 0 | 2725.718 | 239.8341 | 2131.418 | 0 | 4623.814 |
| ADI-23672 | 0 | 1905.496 | 56.37432 | 2320.208 | 0 | 4121.787 |
| ADI-23673 | 0 | 2005.052 | 86.91475 | 4193.993 | 0 | 2627.311 |
| ADI-26906 | 0 | 3849.833 | 70.52744 | 3983.237 | 0 | 9035.443 |
| ADI-26907 | 0 | 1484.849 | 57.70298 | 5005.116 | 0 | 7885.667 |
| ADI-26908 | 0 | 2629.234 | 20.6515 | 4618.489 | 0 | 8357.608 |
| ADI-26909 | 0 | 3533.808 | 15.25265 | 3644.966 | 0 | 5777.494 |
| ADI-26910 | 0 | 2128.518 | 37.69095 | 3142.977 | 0 | 5839.224 |
| ADI-26912 | 0 | 0 | 0 | 0 | 0 | 0 |
| ADI-26913 | 0 | 2235.181 | 0 | 3599.486 | 0 | 3239.355 |
| ADI-26915 | 0 | 0 | 2.579892 | 0 | 0 | 0 |
| ADI-26916 | 0 | 0 | 0 | 14.77678 | 0 | 0 |
| ADI-26917 | 0 | 109.1881 | 0 | 895.5244 | 0 | 60.87033 |
| ADI-26918 | 0 | 0 | 0 | 0 | 0 | 0 |
| ADI-26919 | 0 | 1221.756 | 0 | 1529.324 | 0 | 2607.514 |
| ADI-26920 | 0 | 710.0884 | 0 | 1667.536 | 0 | 787.9412 |

TABLE 1-continued

| ADI clone ID | D5801 10 nM Fab IFNg (pg ml⁻¹) | D5801 10 nM IgG1 IFNg (pg ml⁻¹) | Fab KD Human CD3εδ-Fc (M) Monovalent | Fab KD Cyno CD3εδ-Fc (M) Monovalent | IgG KD Human CD3εδ-Fc (M) Avid | IgG KD Cyno CD3εδ-Fc (M) Avid |
|---|---|---|---|---|---|---|
| ADI-26921 | 0 | 0 | 0 | 1496.688 | 0 | 86.26344 |
| ADI-26924 | 0 | 0 | 0 | 0 | 0 | 0 |
| ADI-26925 | 0 | 0 | 0 | 0 | 0 | 0 |
| ADI-26927 | 0 | 0 | 0 | 8.821052 | 0 | 0 |
| ADI-26928 | 0 | 0 | 0 | 0 | 0 | 0 |
| ADI-26929 | 0 | 0 | 0 | 0 | 0 | 0 |
| ADI-26930 | 0 | 0 | 0 | 0 | 0 | 0 |
| ADI-26932 | 0 | 0 | 0 | 0 | 0 | 0 |
| ADI-26933 | 0 | 1032.987 | 0 | 2752.275 | 0 | 660.8336 |
| ADI-26938 | 0 | 0 | 0 | 0 | 0 | 0 |
| ADI-26939 | 0 | 0 | 0 | 0 | 0 | 0 |
| ADI-26940 | 0 | 0 | 0 | 33.39678 | 0 | 0 |
| ADI-26941 | 0 | 0 | 0 | 0 | 0 | 0 |
| ADI-26942 | 0 | 0 | 0 | 0 | 0 | 0 |
| ADI-26943 | 0 | 0 | 0 | 0 | 0 | 0 |
| ADI-26944 | 0 | 0 | 0 | 0 | 0 | 0 |
| ADI-26945 | 0 | 0 | 0 | 0 | 0 | 0 |
| ADI-26950 | 0 | 0 | 0 | 0 | 0 | 0 |
| ADI-26954 | 0 | 0 | 0 | 521.1572 | 0 | 0 |
| Unstimulated | 0 | 0 | 0 | 2.045886 | 0 | 0 |
| ADI-03847 | 0 | 0 | N.B. | N.B. | N.B. | N.B. |
| ADI-22523 | 698.8879 | 11887.59 | 5.9E−09 | 4.5E−09 | 2.0E−10 | 2.2E−10 |
| ADI-23664 | 117.9867 | 5317.511 | 8.4E−09 | 8.9E−09 | 2.7E−10 | 2.8E−10 |
| ADI-23672 | 172.223 | 4722.399 | 7.7E−09 | 8.8E−09 | 2.5E−10 | 2.4E−10 |
| ADI-23673 | 185.1544 | 8565.428 | 7.6E−09 | 8.2E−09 | 2.7E−10 | 2.9E−10 |
| ADI-26906 | 371.7809 | 9707.526 | 7.7E−09 | 8.1E−09 | 1.6E−09 | 2.5E−10 |
| ADI-26907 | 335.9243 | 8561.689 | 9.6E−09 | 1.1E−08 | 1.8E−09 | 3.0E−10 |
| ADI-26908 | 257.0513 | 7867.79 | 9.1E−09 | 1.0E−08 | 1.5E−09 | 3.1E−10 |
| ADI-26909 | 101.2396 | 5639.143 | 1.4E−08 | 1.6E−08 | 1.9E−09 | 3.2E−10 |
| ADI-26910 | 163.2046 | 5640.78 | 1.4E−08 | 1.6E−08 | 1.4E−09 | 2.6E−10 |
| ADI-26912 | 0 | 0 | 1.3E−07 | 2.1E−07 | 3.0E−09 | 2.0E−09 |
| ADI-26913 | 0 | 4880.937 | 3.5E−08 | 3.8E−08 | 2.2E−09 | 4.0E−10 |
| ADI-26915 | 0 | 0 | 1.4E−07 | P.F. | 3.3E−09 | 2.6E−09 |
| ADI-26916 | 0 | 2.54948 | 1.7E−07 | 1.3E−07 | 2.9E−09 | 1.8E−09 |
| ADI-26917 | 0 | 1026.313 | 1.0E−07 | 1.2E−07 | 2.6E−09 | 1.0E−09 |
| ADI-26918 | 0 | 0 | 1.4E−06 | 2.7E−07 | 3.0E−09 | 2.2E−09 |
| ADI-26919 | 0 | 2959.607 | 5.7E−08 | 5.4E−08 | 2.3E−09 | 5.9E−10 |
| ADI-26920 | 0 | 1783.751 | 7.6E−08 | 7.6E−08 | 3.4E−09 | 7.0E−10 |
| ADI-26921 | 0 | 964.8354 | 9.5E−08 | 8.9E−08 | 3.7E−09 | 9.4E−10 |
| ADI-26924 | 0 | 0 | 2.0E−07 | 2.8E−07 | 2.8E−09 | 2.1E−09 |
| ADI-26925 | 0 | 0 | N.B. | N.B. | 1.1E−08 | 8.7E−09 |
| ADI-26927 | 0 | 8.597335 | 1.3E−07 | 1.5E−07 | 1.1E−09 | 1.1E−09 |
| ADI-26928 | 0 | 0 | N.B. | N.B. | 2.8E−09 | 2.5E−09 |
| ADI-26929 | 0 | 0 | N.B. | N.B. | 1.1E−08 | 9.7E−09 |
| ADI-26930 | 0 | 0 | N.B. | N.B. | 1.0E−08 | 8.7E−09 |
| ADI-26932 | 0 | 0 | N.B. | N.B. | 1.6E−08 | 1.3E−08 |
| ADI-26933 | 0 | 2100.075 | 5.9E−08 | 5.5E−08 | 6.7E−10 | 5.2E−10 |
| ADI-26938 | 0 | 0 | N.B. | N.B. | 1.0E−08 | 1.0E−08 |
| ADI-26939 | 0 | 0 | 3.5E−07 | 2.7E−07 | 1.9E−09 | 1.6E−09 |
| ADI-26940 | 0 | 2.8149 | 1.5E−07 | 1.5E−07 | 1.4E−09 | 1.2E−09 |
| ADI-26941 | 0 | 0 | 1.1E−06 | 2.2E−07 | 1.7E−09 | 2.2E−09 |
| ADI-26942 | 0 | 0 | N.B. | N.B. | 8.5E−09 | 7.8E−09 |
| ADI-26943 | 0 | 0 | N.B. | N.B. | 7.6E−09 | 6.6E−09 |
| ADI-26944 | 0 | 0 | N.B. | N.B. | 1.3E−08 | 1.2E−08 |
| ADI-26945 | 0 | 0 | N.B. | N.B. | 2.0E−08 | 2.1E−08 |
| ADI-26950 | 0 | 0 | N.B. | N.B. | N.B. | N.B. |
| ADI-26954 | 0 | 227.3743 | N.B. | N.B. | N.B. | N.B. |
| Unstimulated | 0 | 0 | #N/A | #N/A | #N/A | #N/A |

Figure 25D:
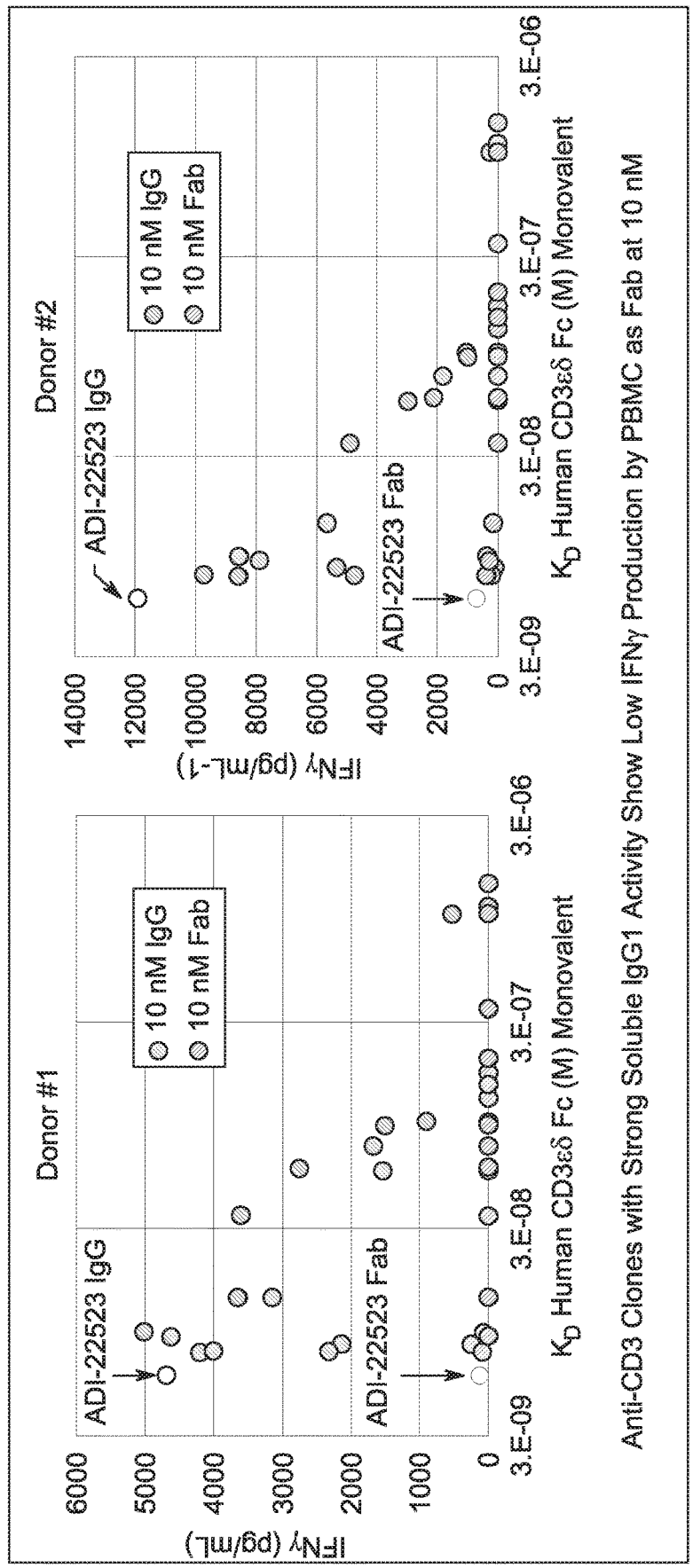

A subset of the data is provided in graphic representation in FIG. 25D. Among other things, a correlation of monovalent affinity with cytokine production was observed for both donors for 10 nM IgG having affinity for Hu and Cy CD3εδ Fc of at least 100 nM. Fab showed low IFNγ production by PBMC at 10 nM, but undetectable IFNγ production at 0.3 nM concentration (FIG. 25D).

scFv Conversion of ADI-21978 (ADI-22523).

Figure 26A:
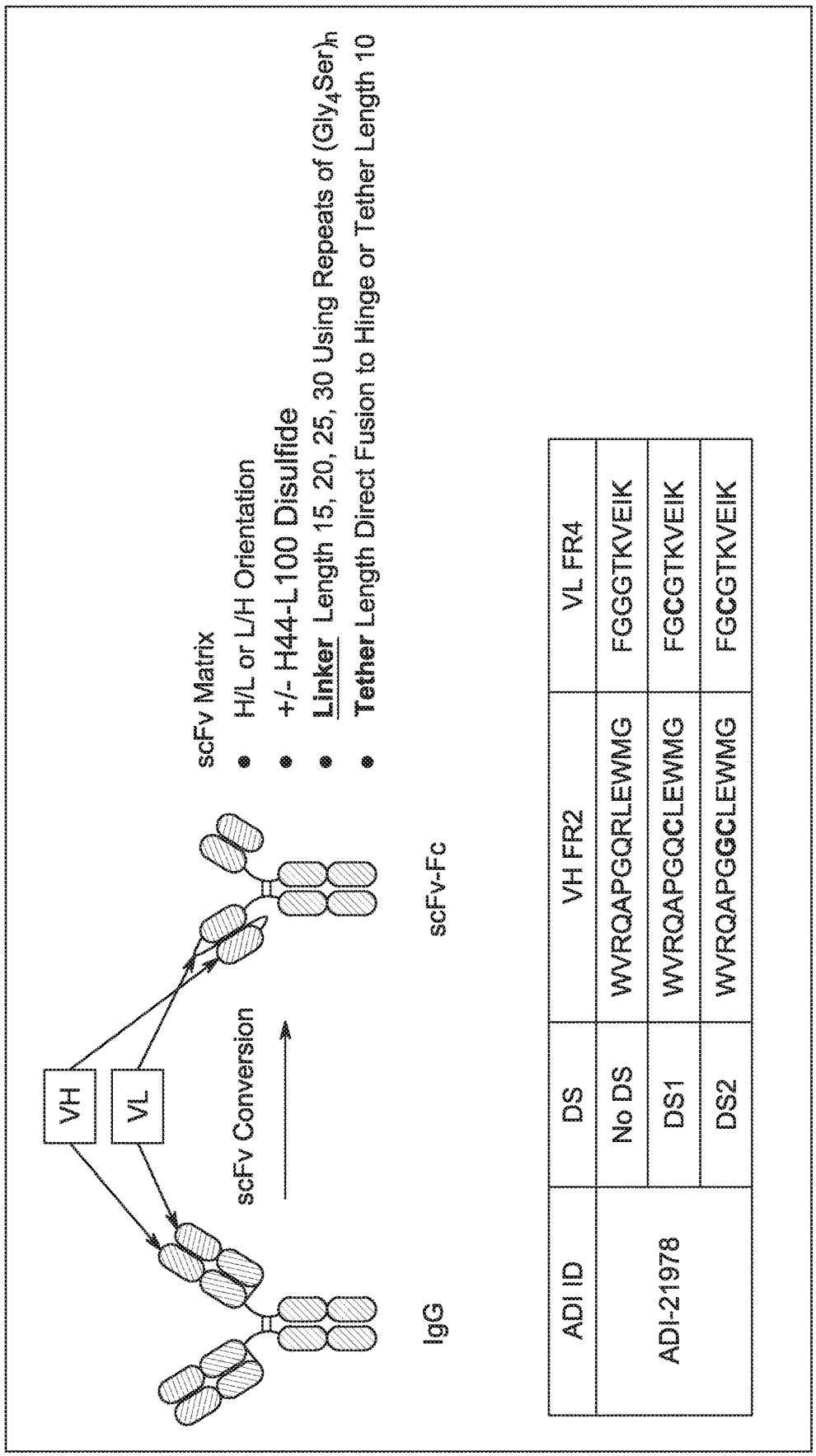
FIGS. 26A-26G show an exemplary depiction of scFv conversion and exemplary linker, VH FR2, and VL FR4 sequences (SEQ ID NOs: 6845-6851) (A), and exemplary data showing scFv-Fc from the ADI-21978 lineage were sequence confirmed, produced, and characterized (B). Additionally, exemplary recombinant CD3 and cell binding analysis revealed that scFv conversion was well tolerated, with 2-4 fold affinity reduction compared to the IgG (C), and many of the scFv-Fc designs exhibited a monomeric non-aggregated peak of 85-90% (D). Further, exemplary thermal stability analysis by DSF showed that ADI-21978 scFv-Fc were generally stable, showing Tm in the range of 65-69° C. (E-F), and inclusion of DS1 and DS2 yielded scFv-Fc with parent-like HIC retention time, whereas scFv-Fc without DS1/2 had a broad peak profile and delayed retention time (G).
Figures 26B, 26C:
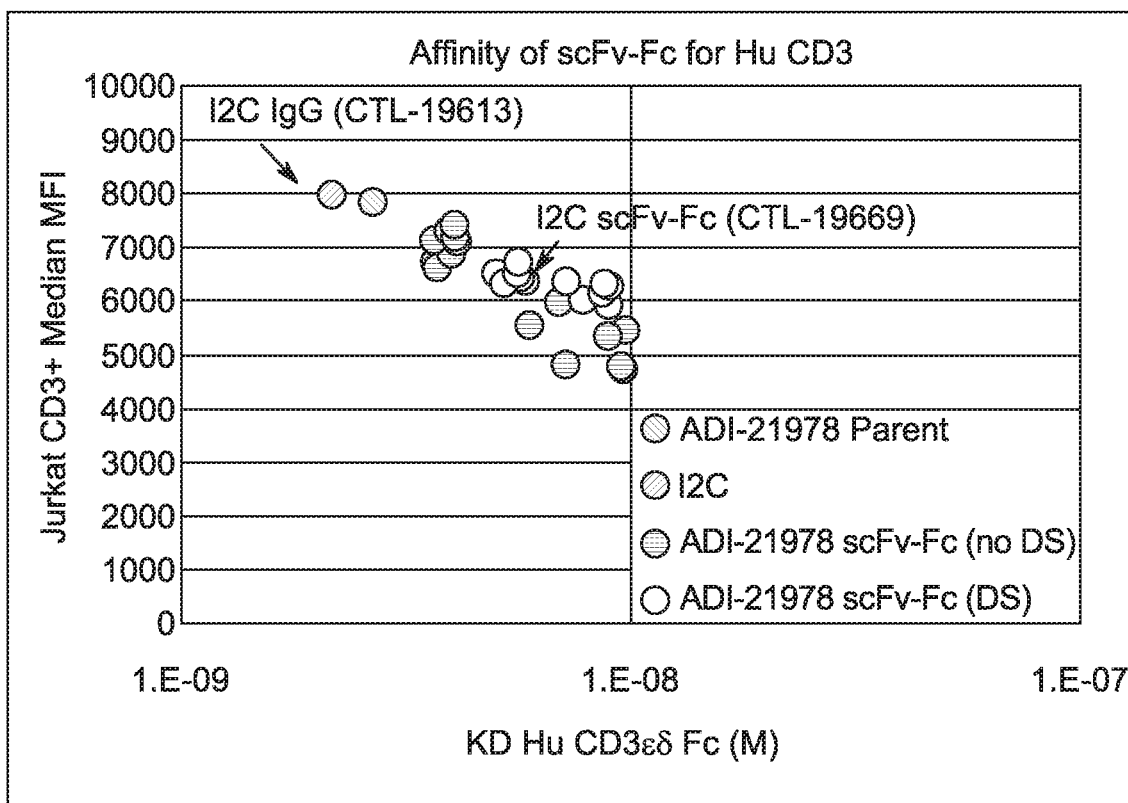
Figure 26D:
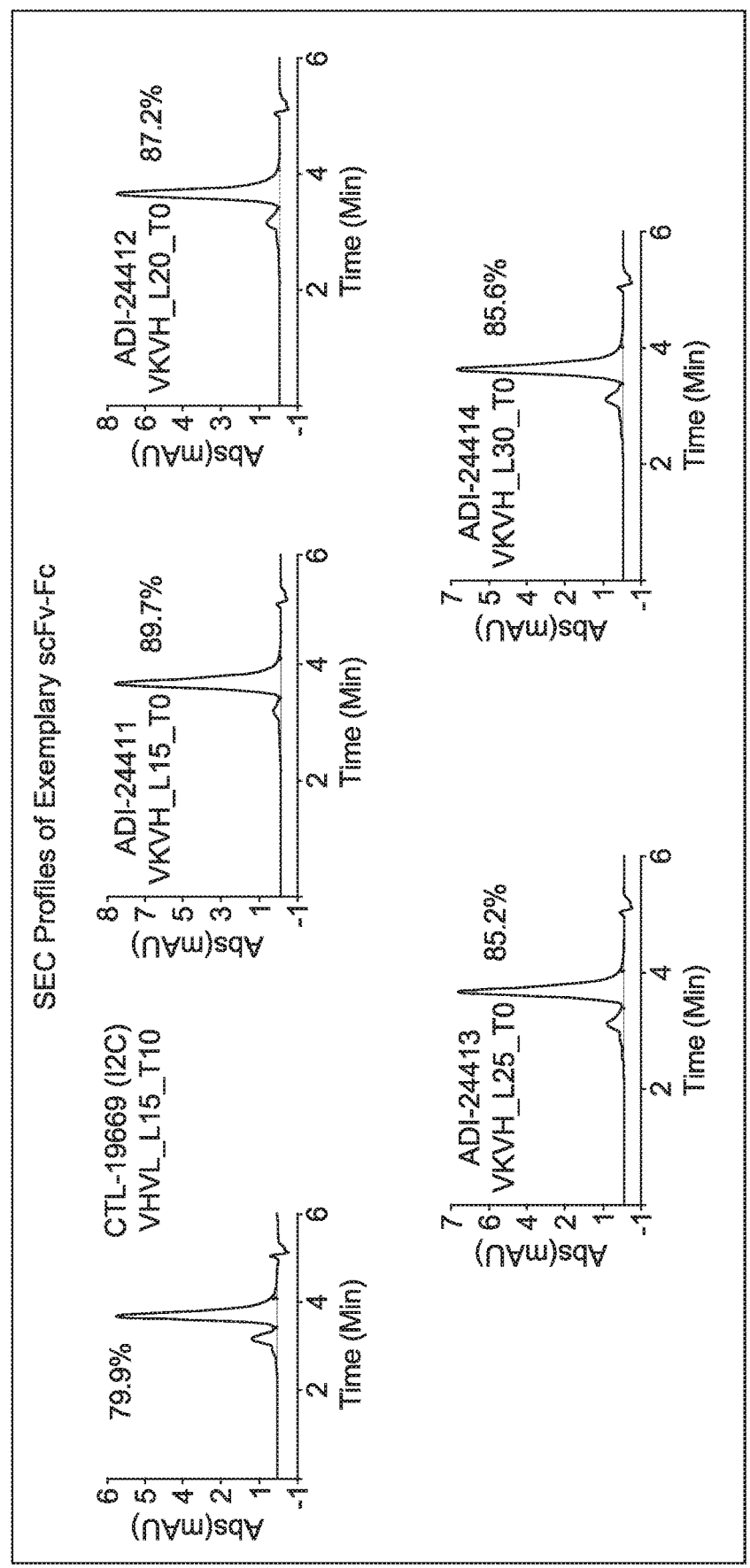
Figures 26E, 26F:
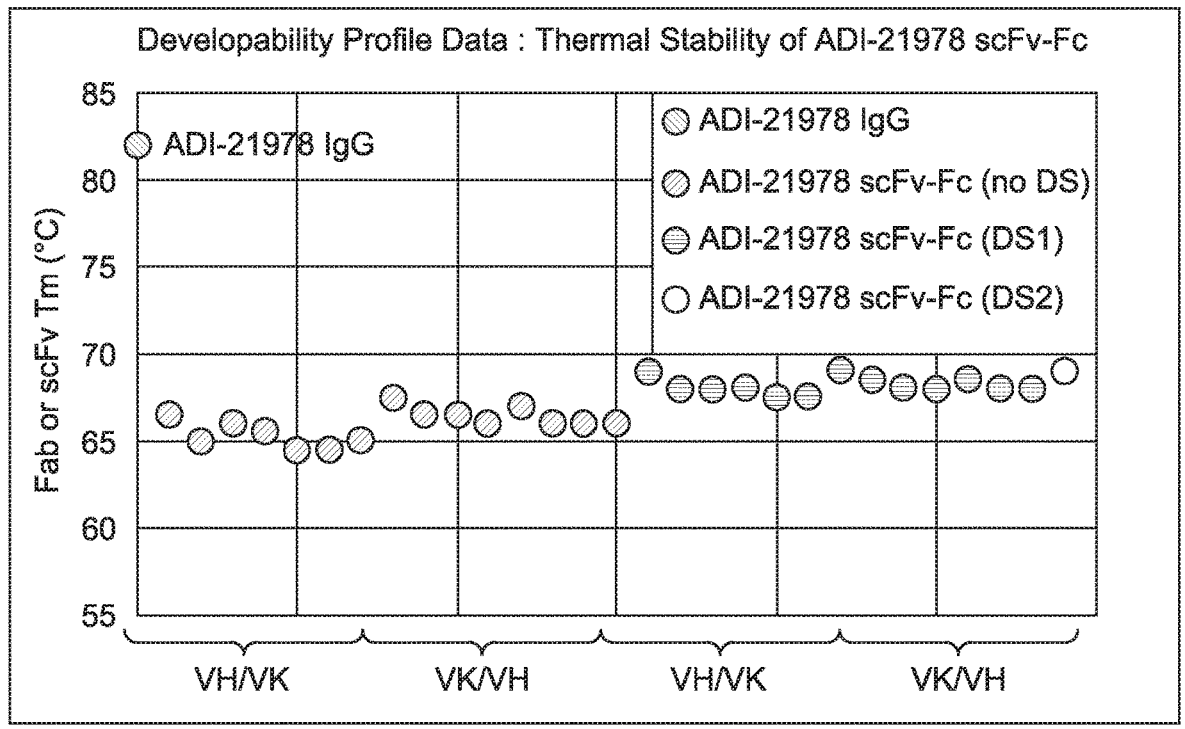
Figure 26G:
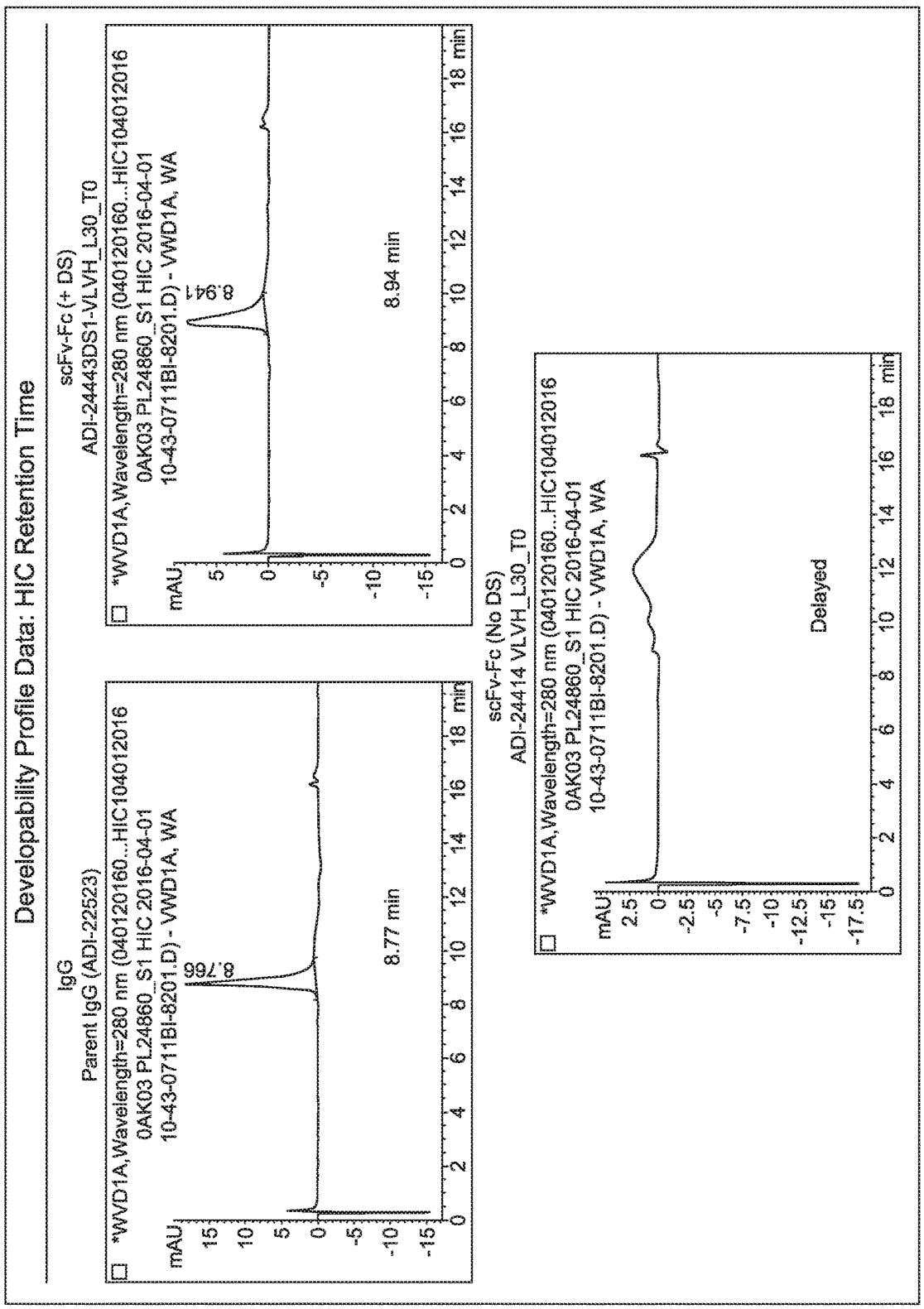

VH and VL were amplified and reassembled by overlap extension PCR to generate a matrix of scFv fused to IgG1 Fc (hereafter referred to as scFv-Fc and depicted in FIG. 26A). In brief, the design matrix consisted of the VH/VK or VK/VH orientation, inclusion or exclusion of VH-144-VK100 (Kabat numbering) disulfide (DS1) (Brinkmann U. et al. PNAS 1993), tether 5 or direct fusion, linker lengths of 15, 20, 25, and 30 amino acids. A modified VH44-VK 100 disulfide (DS2) was also explored. Tether and linker sequences consisted of (Gly4Ser)$_N$ repeats. The IgG1 upper hinge includes a Cys220Ser mutation in and scFv fusions were made to Glu216. Twenty-nine scFv-Fc from the ADI-21978 lineage were sequence confirmed, produced, and characterized (FIG. 26B). Recombinant CD3 and cell binding analysis revealed that scFv conversion was well tolerated, with 2-4 fold affinity reduction compared to the IgG (FIG. 26C). Many of the scFv-Fc designs exhibited a monomeric non-aggregated peak of 85-90% a (FIG. 26D). Thermal stability analysis by DSF showed that ADI-21978 scFv-Fc were generally stable, showing Tm in the range of 65-69° C. (FIG. 26E and FIG. 26F). The inclusion of DS1 and DS2 yielded scFv-Fc with parent-like HIC retention time, whereas scFv-Fc without DS1/2 had a broad peak profile and delayed retention time (FIG. 26G).

Example 2: Generation of SP34 (Anti-CD3) Variant Antibodies: Humanization and Optimization SP34

Humanization of SP34.

Humanization of SP34 was conducted by screening an initial panel of humanization designs produced in yeast (FIG. 27). In brief, 28 designs representing combinations of four humanized VH and seven humanized Vκ or Vλ were produced in yeast and characterized for binding to Hu CD3εδ and Cy CD3εδ Fc. Due to relatively low expression titers, five selected HuSP34 designs were produced by transient HEK and evaluated for recombinant antigen binding, cell staining, and developability profiles (FIG. 27). Of these, ADI-16606 (a combination of HC2 with LC3) was selected for having good binding and the cleanest developability profile, as indicated by AC-SINS and PSR data. Notably, background binding to CD3-expressing Jurkat cells (Jurkat CD3+), Jurkat cells not expressing CD3 (Jurkat CD3-), and Cyno HSC-F was comparable to chimeric SP34 (ChSP34).

Affinity Optimization from the HuSP34 Effort Leading to ADI-26956 and Related Antibody Variants.

Figure 28A:
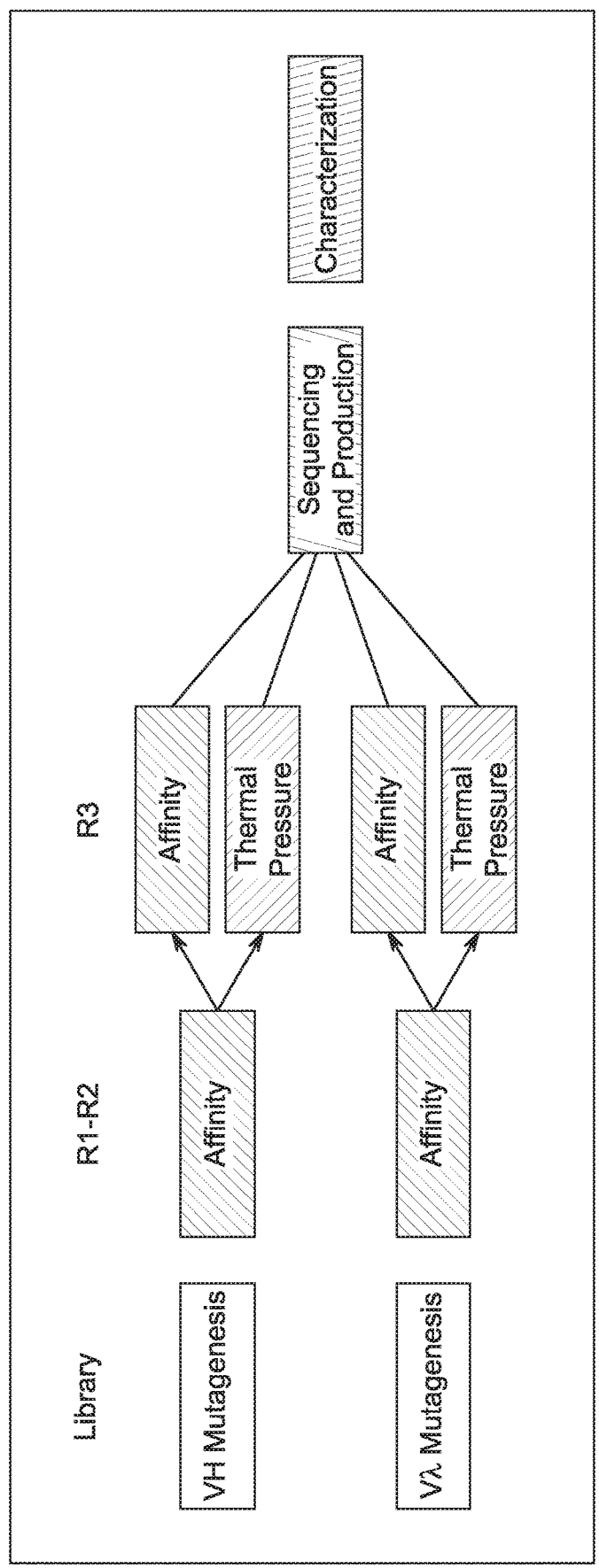
Figure 28B:
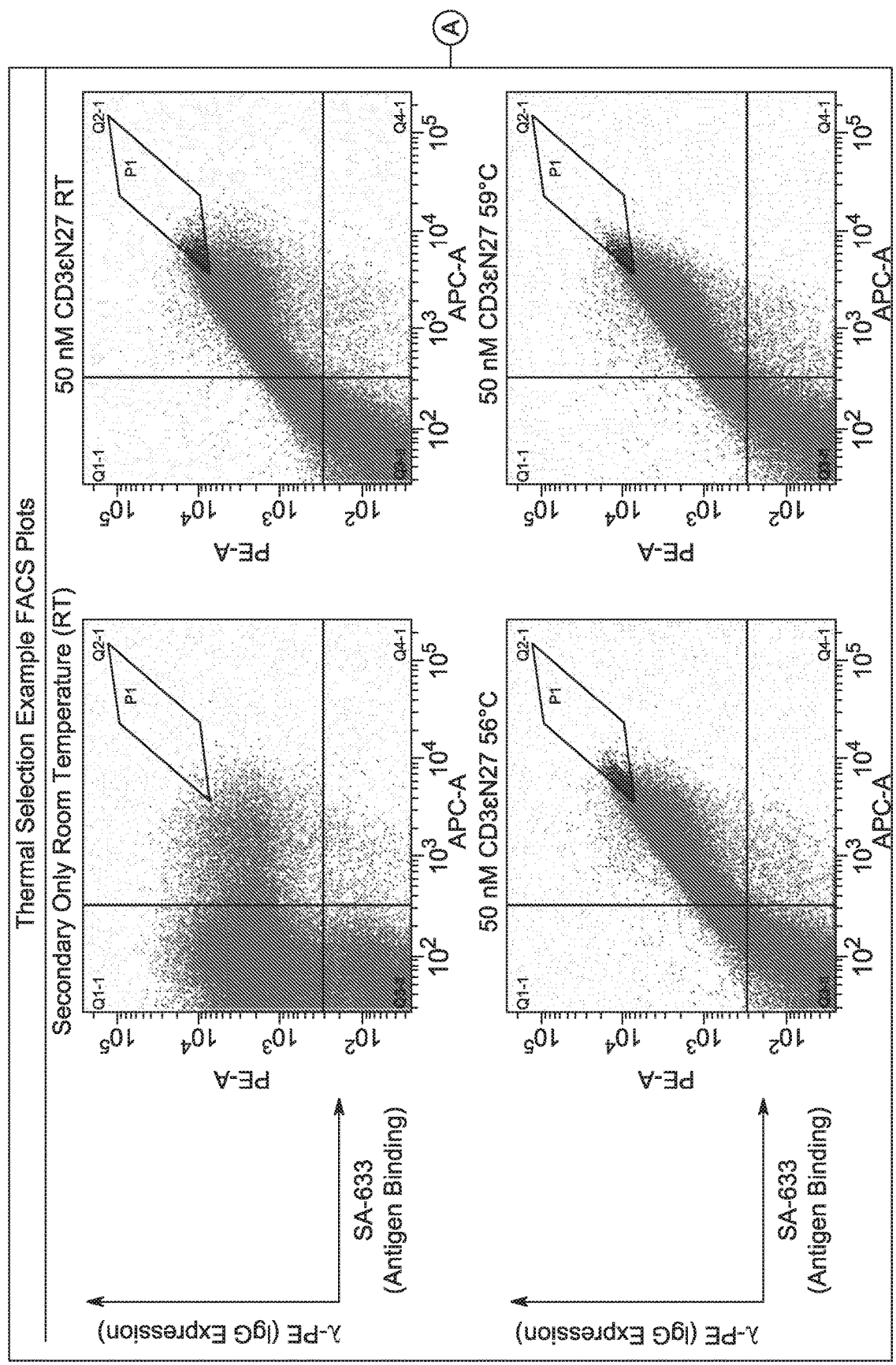
Figure 28B:
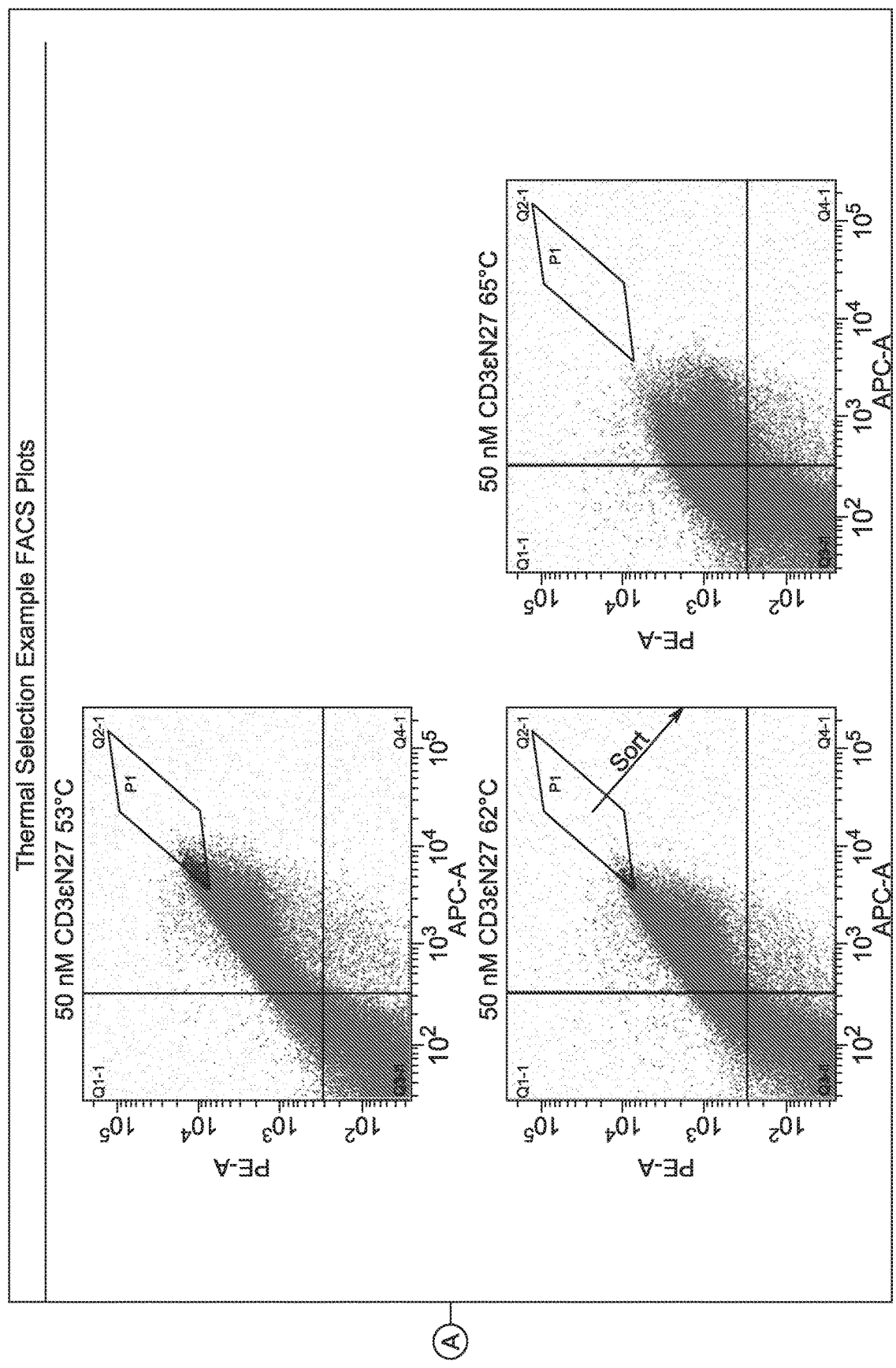
Figure 28C:
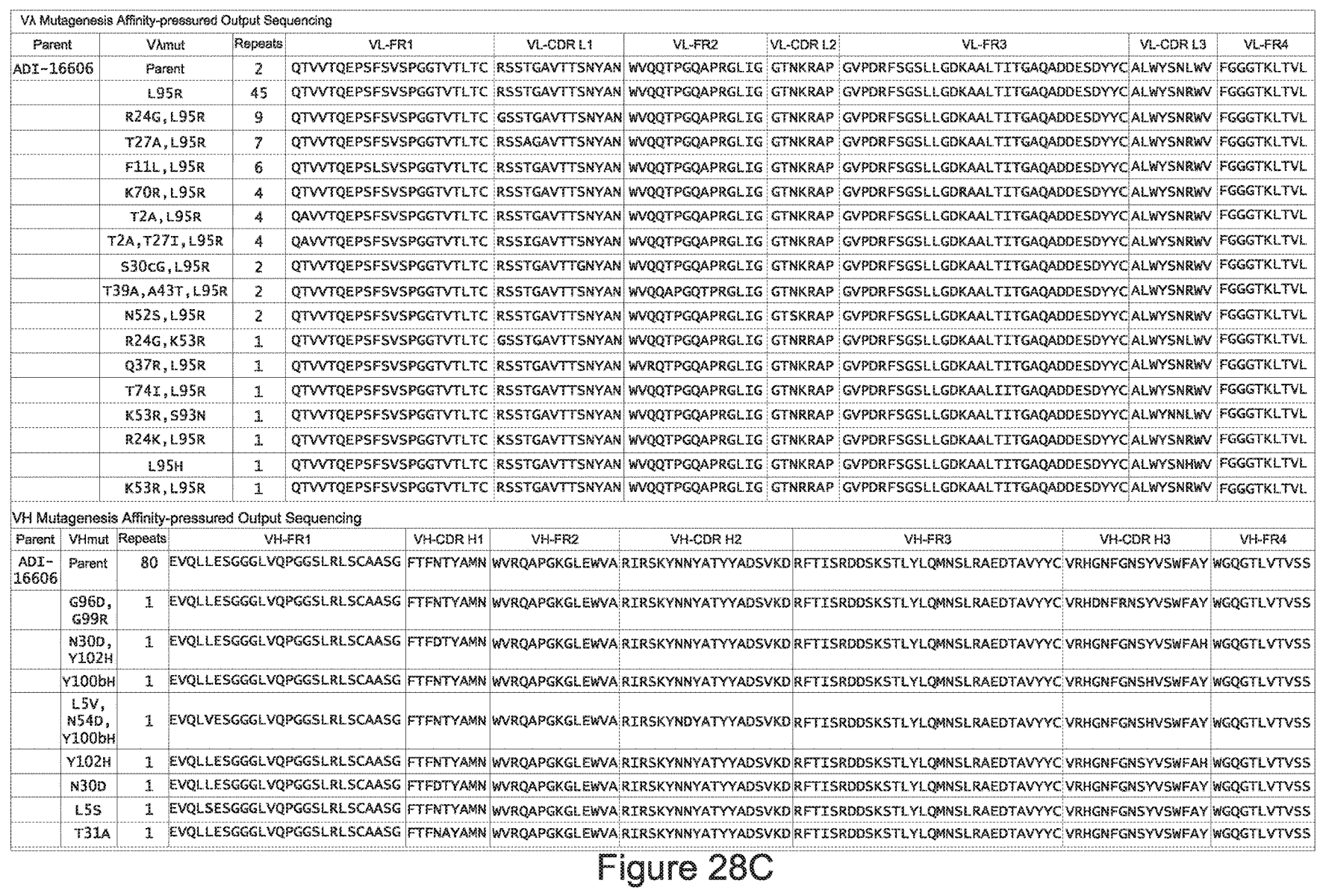

A first effort was undertaken to affinity-mature the human/cyno cross-reactive humanized anti-CD3 SP34 antibody (HuSP34) ADI-16606 (see FIG. 28A for schematic of selection procedure and FIG. 28B for exemplary flow cytometry selection plots). Briefly, a diversified antibody library was created by introducing stochastic diversity across the heavy and light chain variable domain regions. This resulted in a library exceeding $10^8$ in realized diversity. Briefly, selection pressures for rounds 1 and 2 (R1 and R2) included biotinylated Hu CD3εδ Fc antigen titration from 50-5 nM, with selection of binders from the 10 nM condition gated for increased expression and antigen binding with respect to parent. In a third round (R3) antigen was titrated to 0.2 nM and selected binders, representing affinity-pressured progeny, were plated, sequenced, and produced. In a parallel effort, the R2 outputs were subjected to thermal pressure at R3. In brief, the enriched binding populations were subjected to thermal pressure by incubation of yeast at a range of temperature conditions spanning 53-65° C. for 10 min in a thermocycler. After the yeast were cooled to 4° C., 50 nM CD3εN27 antigen was applied and the optimal condition for sorting was identified. Plasmids were released from sorted yeast using a Zymo Research kit, transformed into electrocompetent *E. coli*, mini-prepped from *E. coli*, and re-transformed into the cycle 1 parent HC or LC strains for VX and VH mutagenesis, respectively. Affinity and thermal pressures yielded divergent sequence collapse and consensus motifs (FIGS. 28C and 28D). Unique clones were produced and characterized for Fab and IgG binding to recombinant Hu and Cy CD3εδ Fc antigens, Hu and Cy cell binding, IL-2 production by Jurkat cells, polyspecific reactivity (PSR), self-interaction propensity (AC-SINS), and thermal stability by DSF.

Optimization of HuSP34 Cycle 2; VH×Vλ Chain Shuffle and VH Mutagenesis and Vλ Mutagenesis.

Figure 29A:
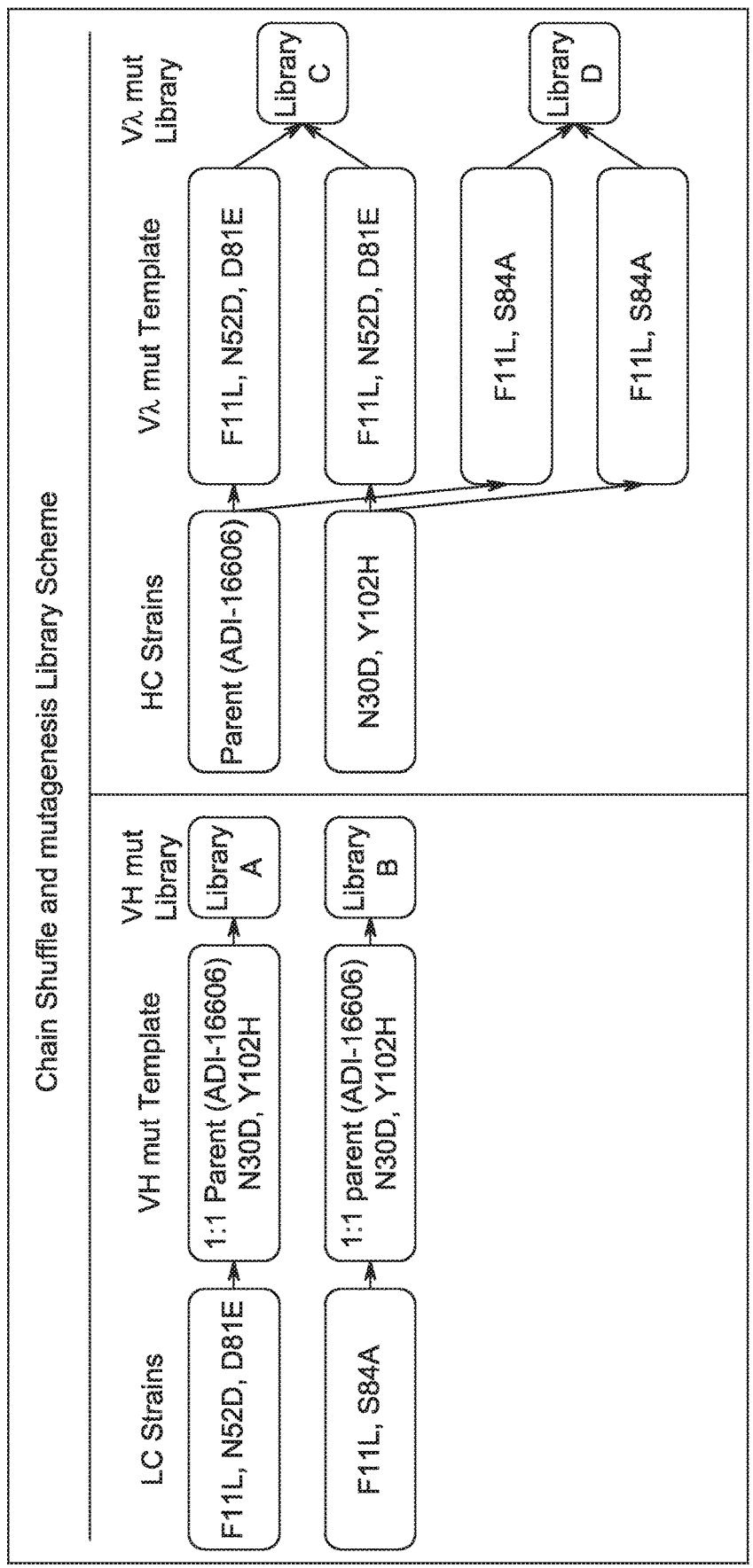

Selected HC and LC from cycle 1 output were shuffled and diversified by error-prone PCR (FIG. 29A). Selection were carried out utilizing similar affinity and thermal pressures as cycle 1 (FIG. 29B). Unique output sequences were produced and characterized. ADI-20587, ADI-20607, and ADI-20590 were selected for another cycle of optimization.

Optimization of HuSP34 Cycle 3; Vλ Rational Combination with 3×VH.

Figure 30:
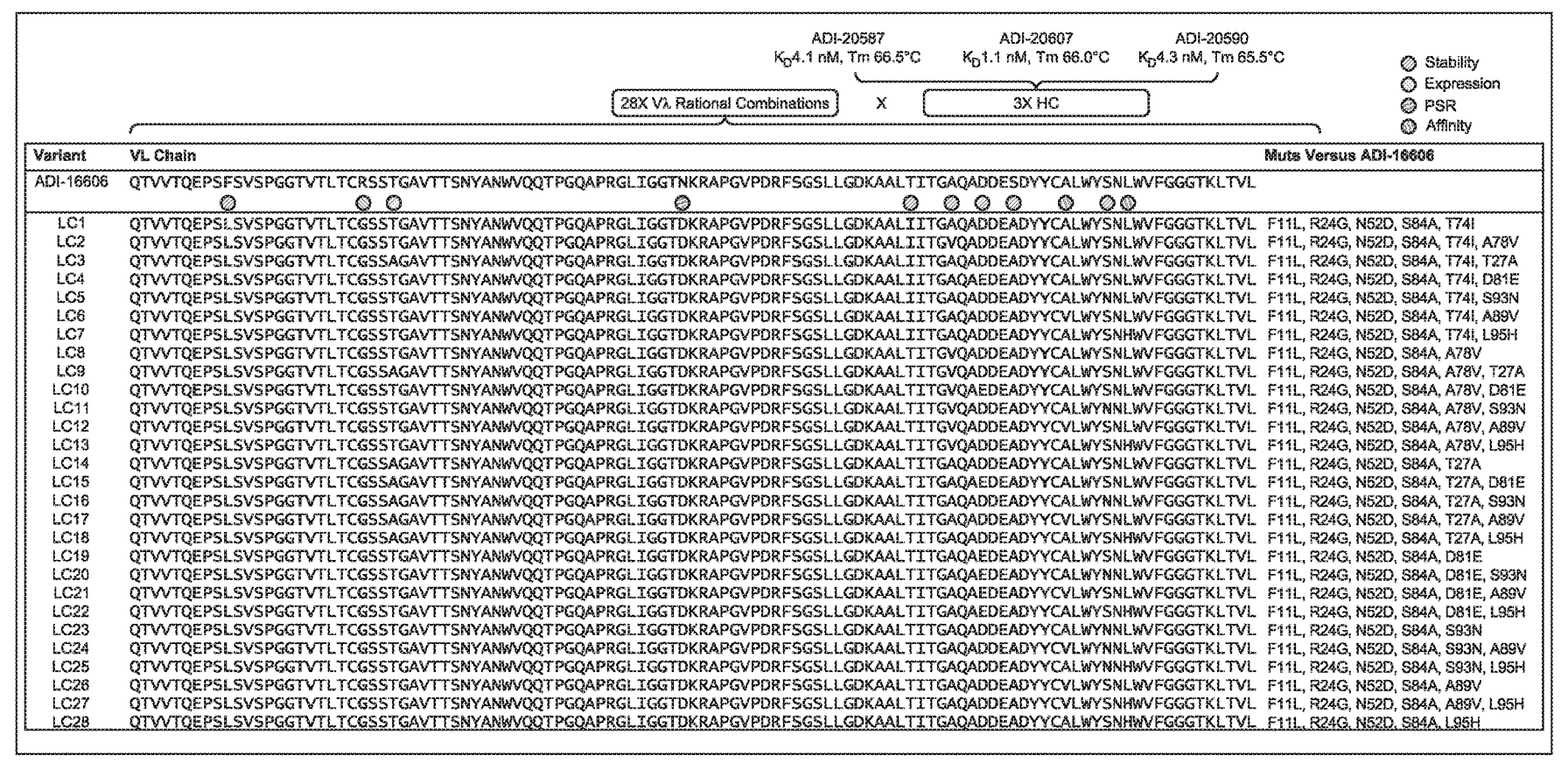

HC from ADI-20587, ADI-20607, and ADI-20590 were used to produce a matrix with 28 rationally-designed LC (FIG. 30). The LC combined the most favorable mutations selected in cycles 1 and 2. In brief, Vλ mutations that increase thermal stability (F11L, T27A, T74I, A78V, D81E, S84A, and S93N), improve expression (R24G), decrease PSR (N52D), and improve affinity (A89V and L95H) were combined. Sequence-confirmed clones were produced and characterized. ADI-21952, a combination of the HC from ADI-20587 and a designed LC carrying the mutations F11L, R24G, N52D, D81E, S84A, and L95H, was selected for further due to a combination of affinity, cell binding, IL-2 production, thermal stability, and PSR.

Optimization of HuSP34 Cycle 4; Rational Mutation of Potential Degradation Sequence Motifs.

Potential degradation motifs in ADI-21952 were observed in VH FR3, NS (Asn-Ser) and CDR H3, NG (Asn-Gly). These sites were rationally mutated to according to the following substitutions: NG→EG (Glu-Gly) or NA (Asn-Ala) and NS→ES (Glu-Ser) or NA. The two sites were combined in a combinatorial matrix and the variant IgG were produced and characterized. Comparison of ADI-21952 (parent) and ADI-23634 and ADI-23637 showed that both rational mutations of the CDR H3 NG site significantly impacted affinity whereas mutations of the FR3 NS site as observed for ADI-23633 and ADI-23636 did not significantly impact properties (FIG. 31).

Optimization Cycle 5; CDR H3 Mutagenesis to Resolve the NG Motif.

ADI-23633 was selected for diversification by site-saturation (NNK) mutagenesis targeting the degradation motif NG in CDR H3. A single round of affinity pressure using the CD3εN13 at 10 nM condition was performed. Selected progeny were produced and characterized, yielding at least two variants with comparable or improved affinity with respect to parent (FIG. 32).

Optimization Cycle 6; Affinity Modulation by Rational Combination.

Figure 33A:
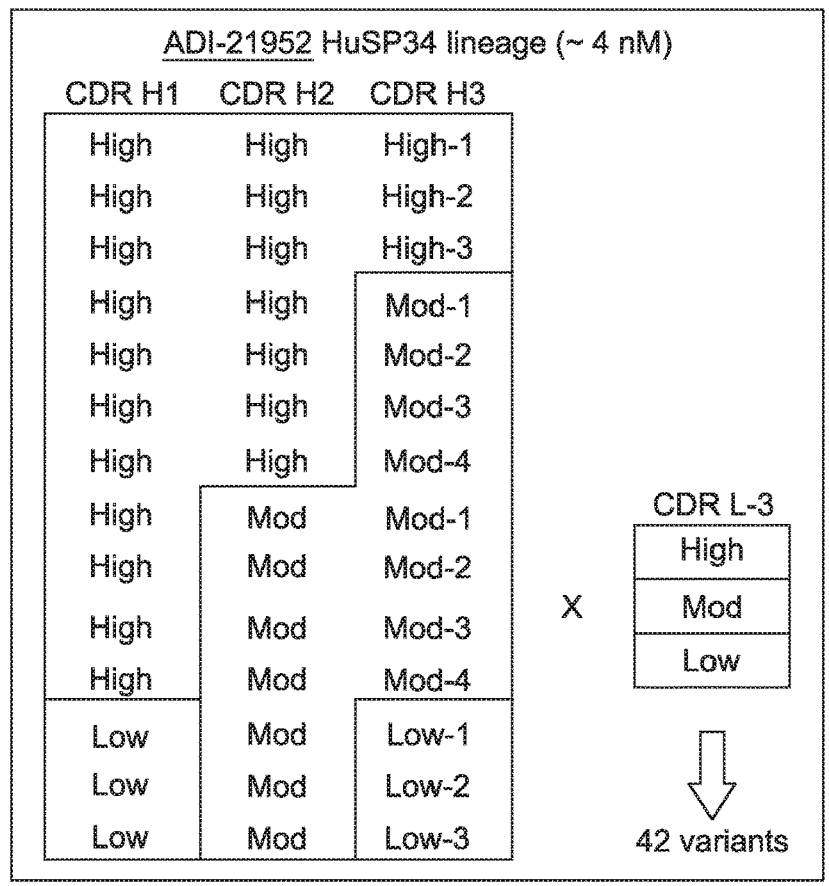
FIGS. 33A-33C show exemplary rational variegation of ADI-21952 by a matrix of CDR H1, CDR H2, and CDR H3 sequences known to affect affinity with CDR L3 sequences known to affect affinity to yield a panel of 42 combinations (A), and exemplary characterization of sequence-confirmed antibodies for recombinant antigen (B) and cell binding (C).
Figure 33B:
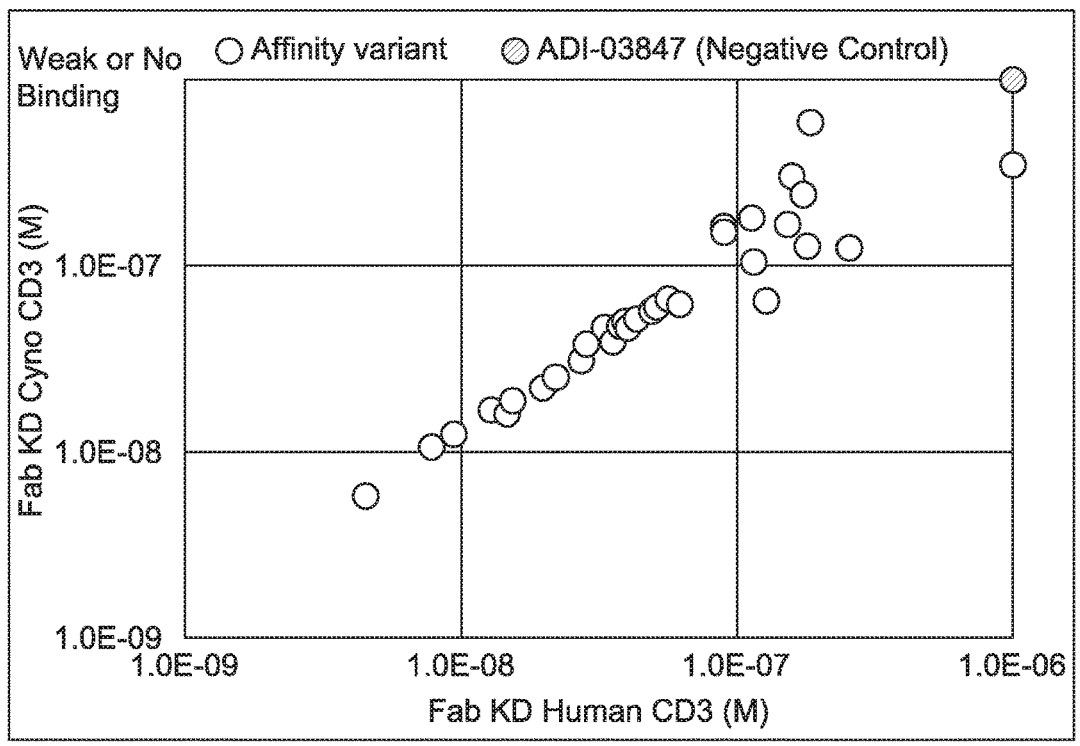
Figure 33C:
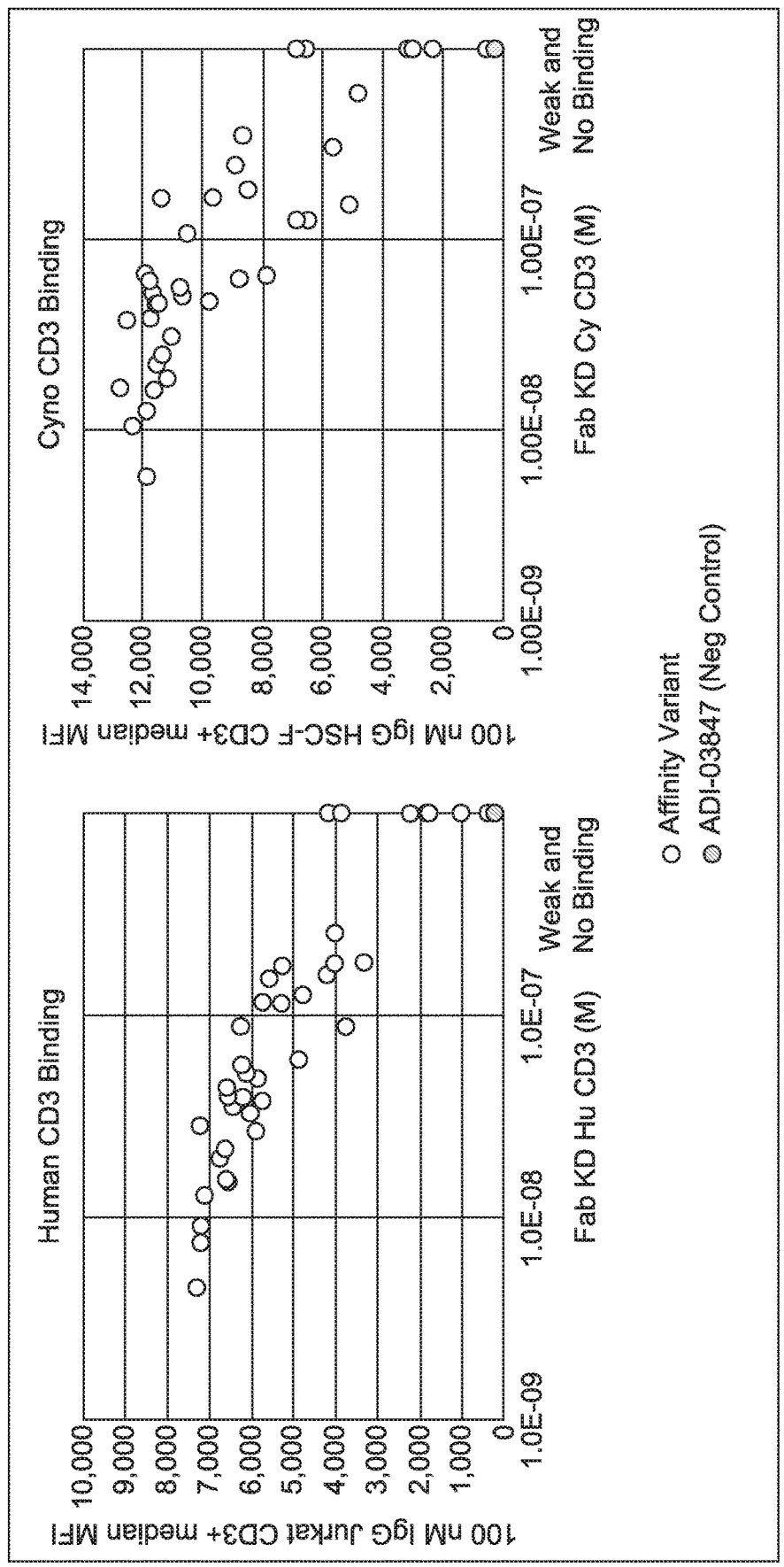

ADI-21952 was rationally variegated by a matrix of CDR H1, CDR H2, and CDR H3 sequences known to affect affinity with CDR L3 sequences known to affect affinity to yield a panel of 42 combinations (FIG. 33A). The resulting sequence-confirmed antibodies were produced in yeast and characterized for recombinant antigen (FIG. 33B) and cell binding (FIG. 33C). Monovalent Fab binding affinity spanned a range of nM-μM and correlated with cell binding median MFI at 100 nM IgG test concentration (FIGS. 33B and 33C).

scFv Conversion of ADI-21952.

Figure 34A:
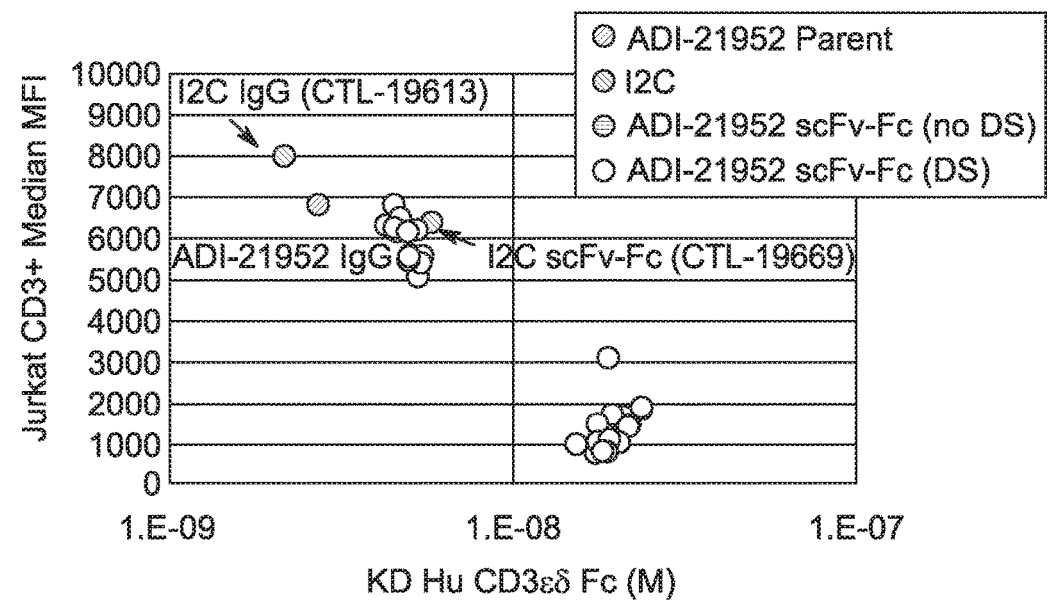
FIGS. 34A-34D show an exemplary recombinant CD3 and cell binding analysis (A), exemplary developability profile data (B), an exemplary thermal stability analysis by DSF (C), and exemplary HIC Retention Time data (D).
Figure 34B:
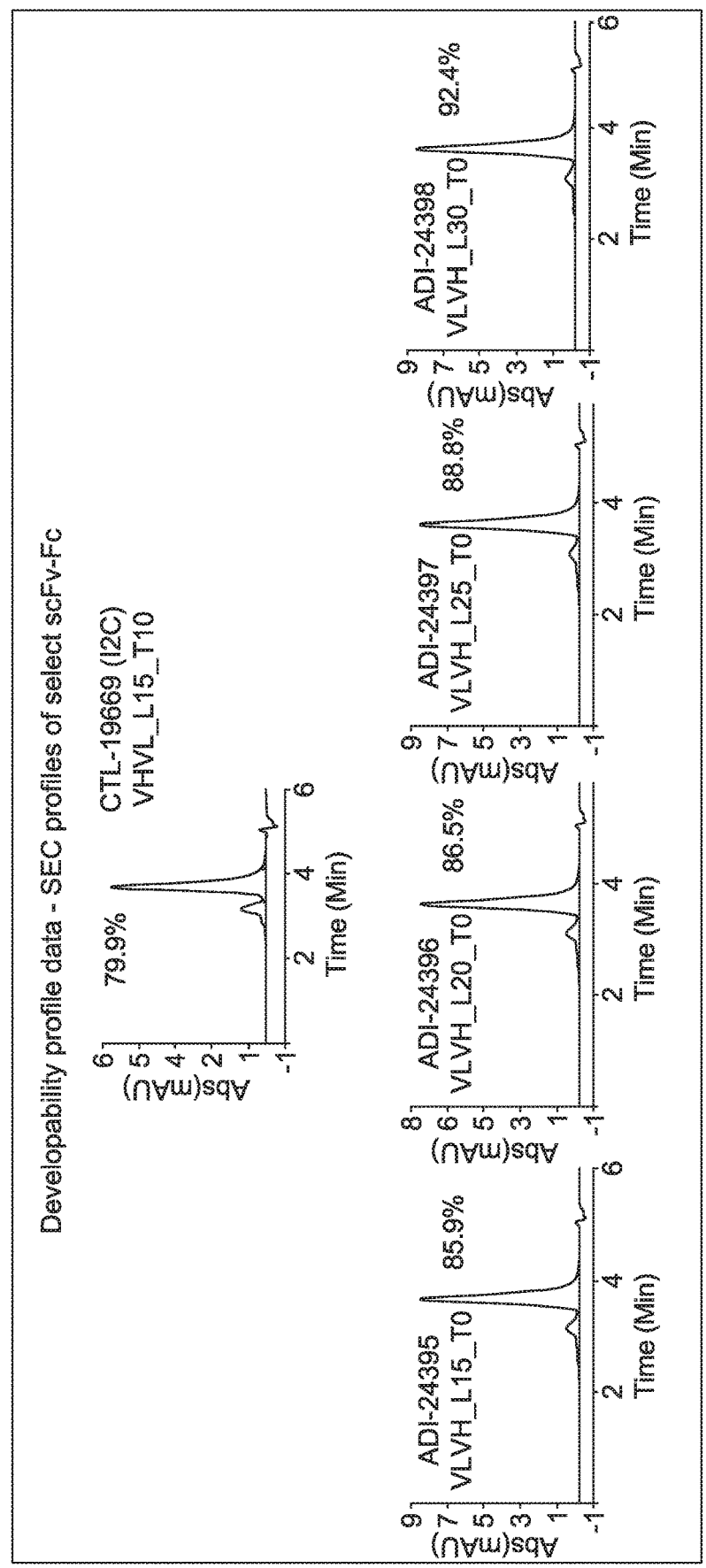
Figure 34C:
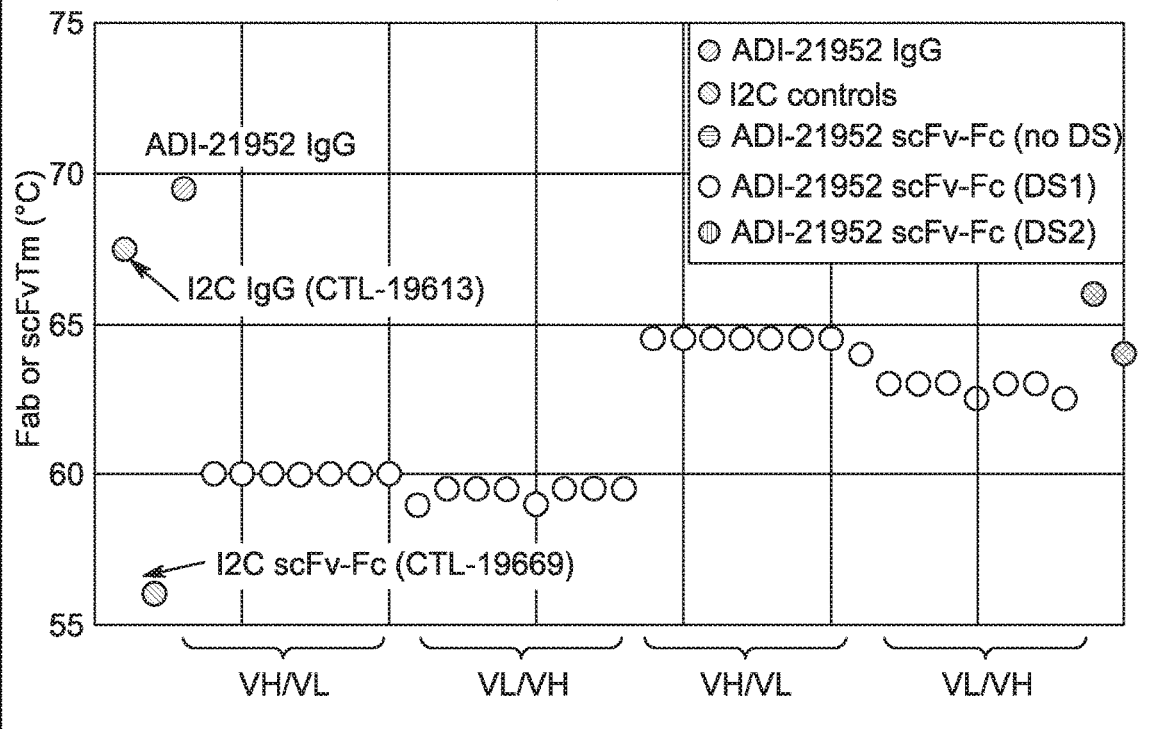
Figure 34D:
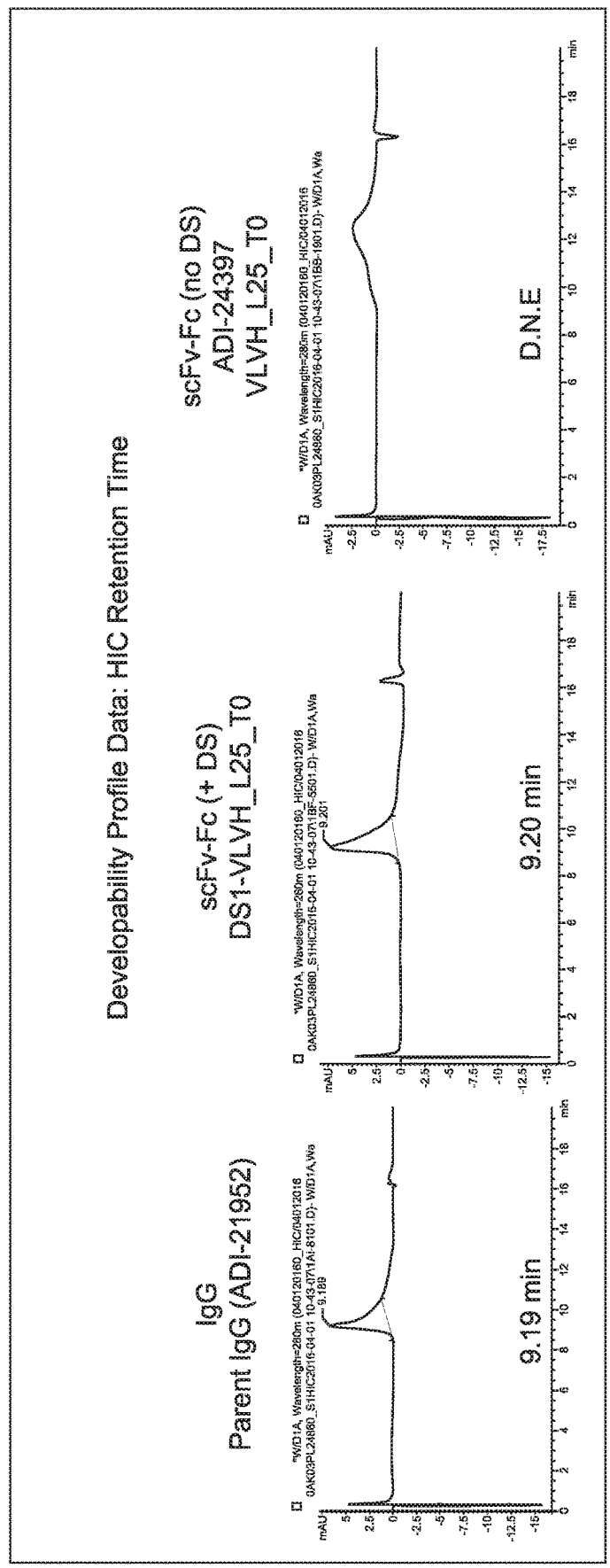

VH and VL were amplified and reassembled by overlap extension PCR to compose a matrix of scFv fused to IgG1 Fc. The design matrix was identical to that utilized for ADI-21978 conversion. Recombinant CD3 and cell binding analysis revealed a <2-fold reduction in affinity compared to the IgG for scFv that do not contain DS1 or DS2, but a significant decrease in affinity for disulfide-containing scFv (~8-fold) (FIG. 34A). Many of the scFv-Fc designs exhibited a monomeric non-aggregated peak of 85-90%, a few designs showed >90% monomer content (FIG. 34B). Thermal stability analysis by DSF showed that ADI-21952 scFv-Fc were metastable, showing Tm in the range of 59-66° C. (FIG. 34C). The inclusion of DS1 and DS2 yielded scFv-Fc with parent-like HIC retention time, whereas scFv-Fc without DS1/2 had a broad peak profile and delayed retention time (FIG. 34D).

HEK PRODUCTION PANEL OF BROAD AFFINITY FOR DEVELOPABILITY PROFILING.

Figure 35B:
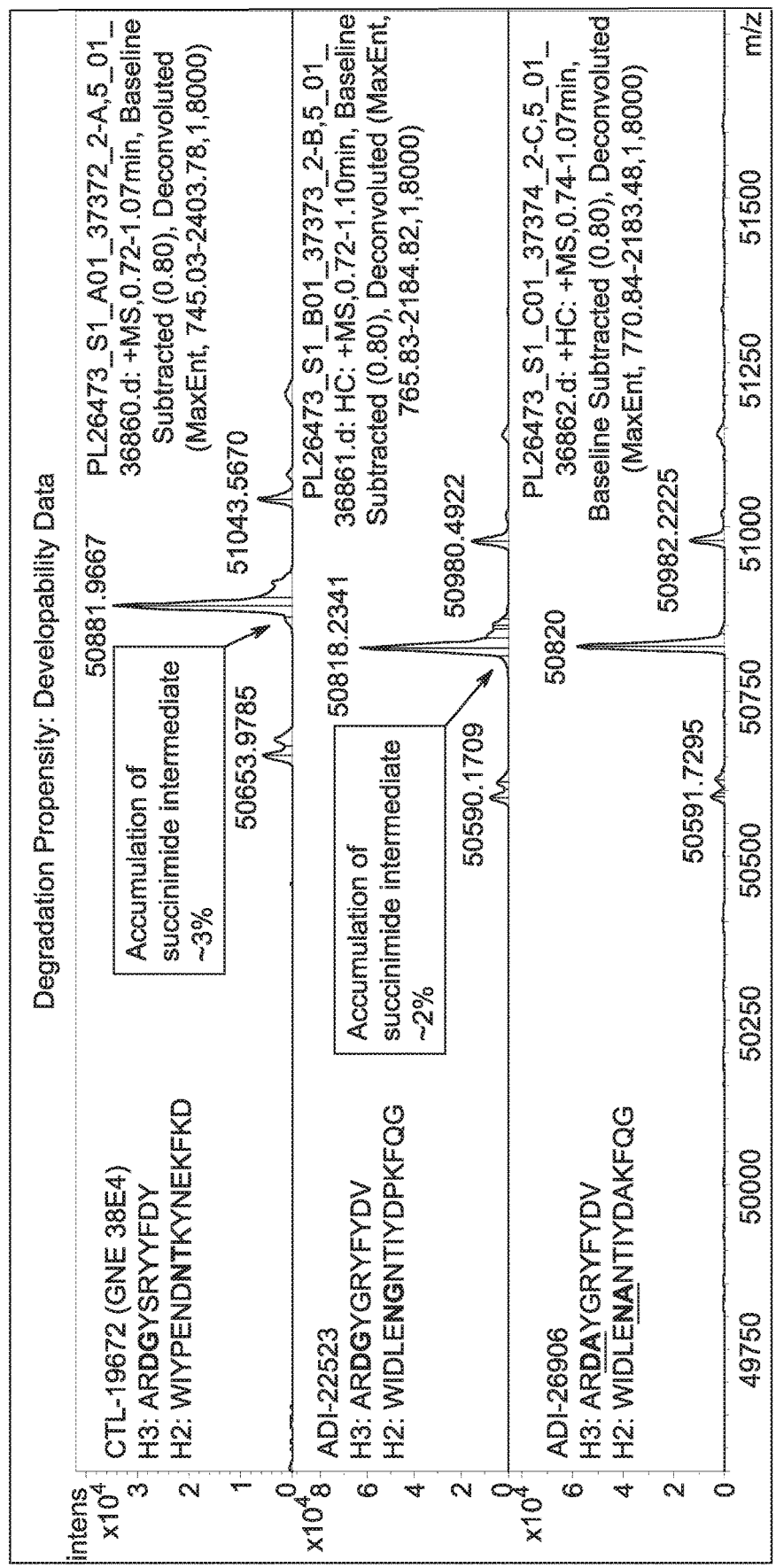

A focused panel of variants representing a broad affinity range was selected for production in HEK. IgG and Fab were characterized for binding affinity to recombinant Hu and Cy CD3εδ Fc and human and cyno cell lines (FIG. 35A). Developability assays included PSR, baculovirus particle assays, HIC, SEC, AC-SINS (self-interaction), Fab Tm by DSF, transient HEK titer. Chemical integrity was assessed by inspection of the intact HC peak breadth and symmetry (se FIG. 35B). A literature control antibody, CTL-19672 (GNE 38E4 as disclosed in, e.g., US patent application publication number US 2015/0166661), and the novel lineage binder with unresolved potential degradation sites, ADI-22523, demonstrated succinimide intermediate formation under non-stress conditions (FIG. 35B). ADI-26906, which has all predicted liability sites resolved, does not show peak broadening, supporting the beneficial role of these modifications for chemical stability of the antibody.

HEK Production of CD3×TAA Bispecifics.

Figure 36A:
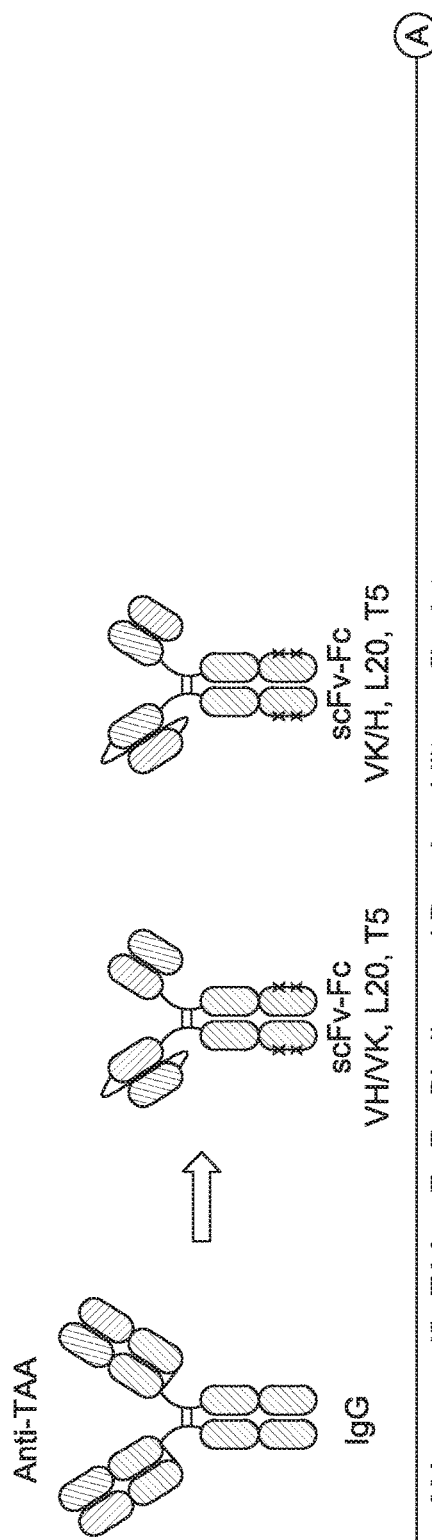
FIG. 36A-36C show exemplary properties of monospecific TAA scFv-Fc (binding and developability profile data) (A), exemplary purification of heterodimer was achieved by pH gradient elution (B), exemplary graphs showing testing of CD3/HER2 bispecifics and TAA control for their ability to activate T cells in the presence and absence of HER2 expressing cells (C).
Figure 36B:
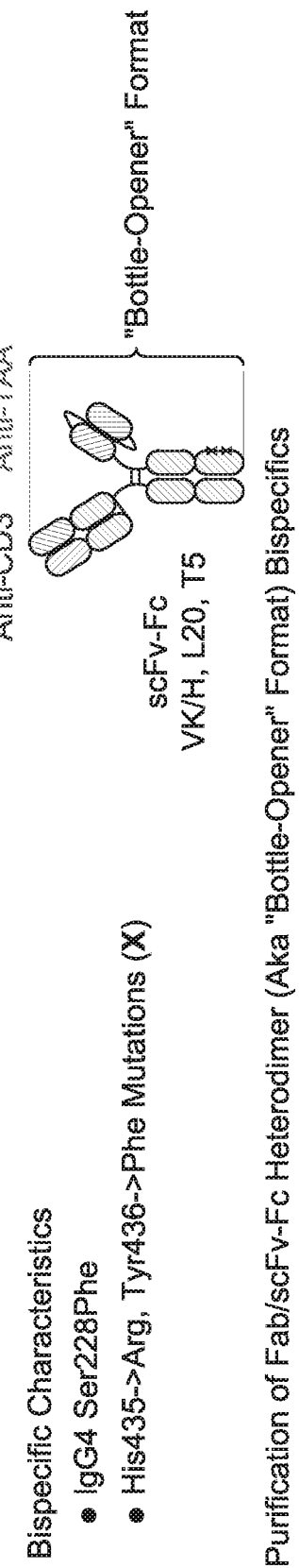
Figure 36B:
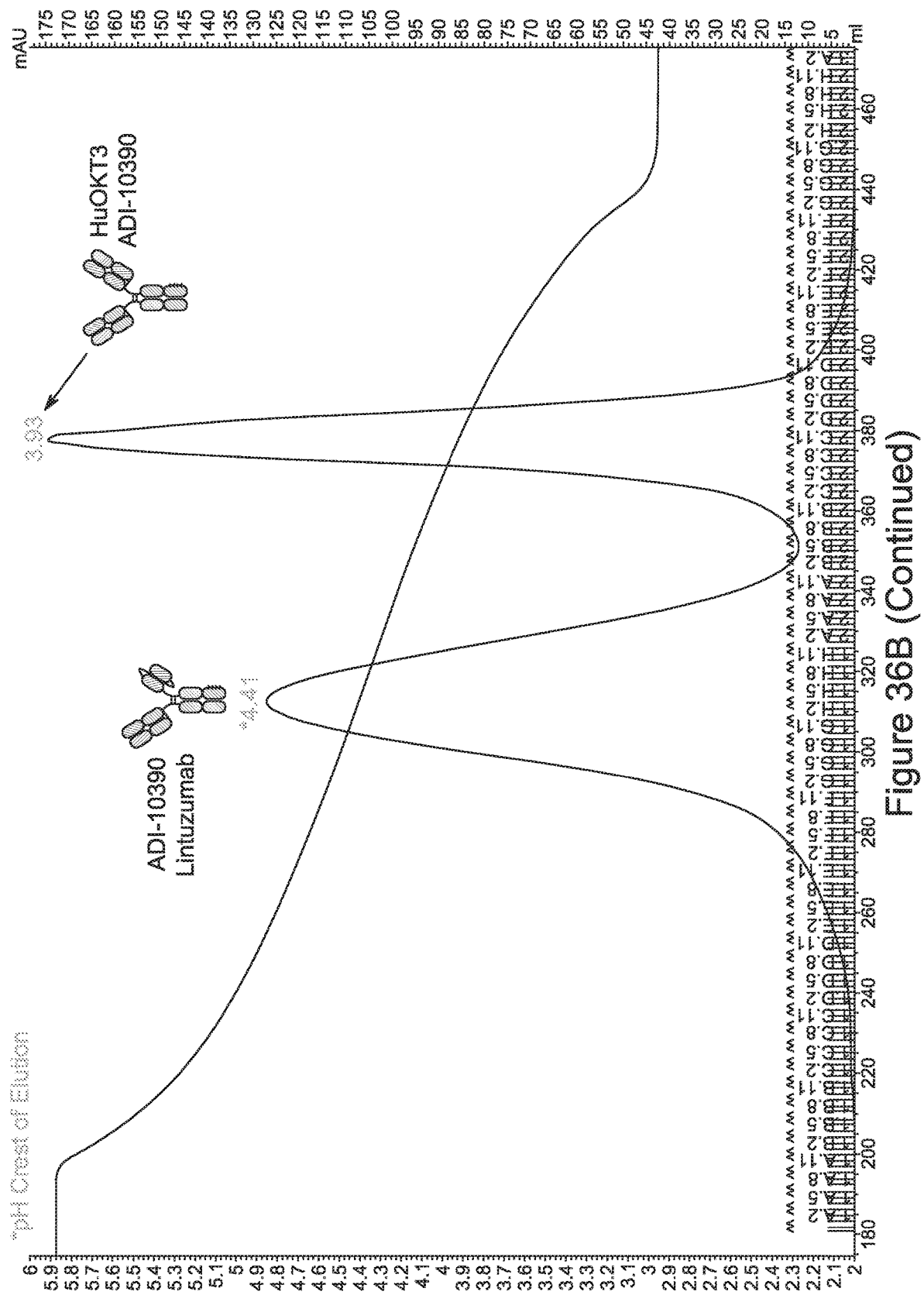
Figure 36B:
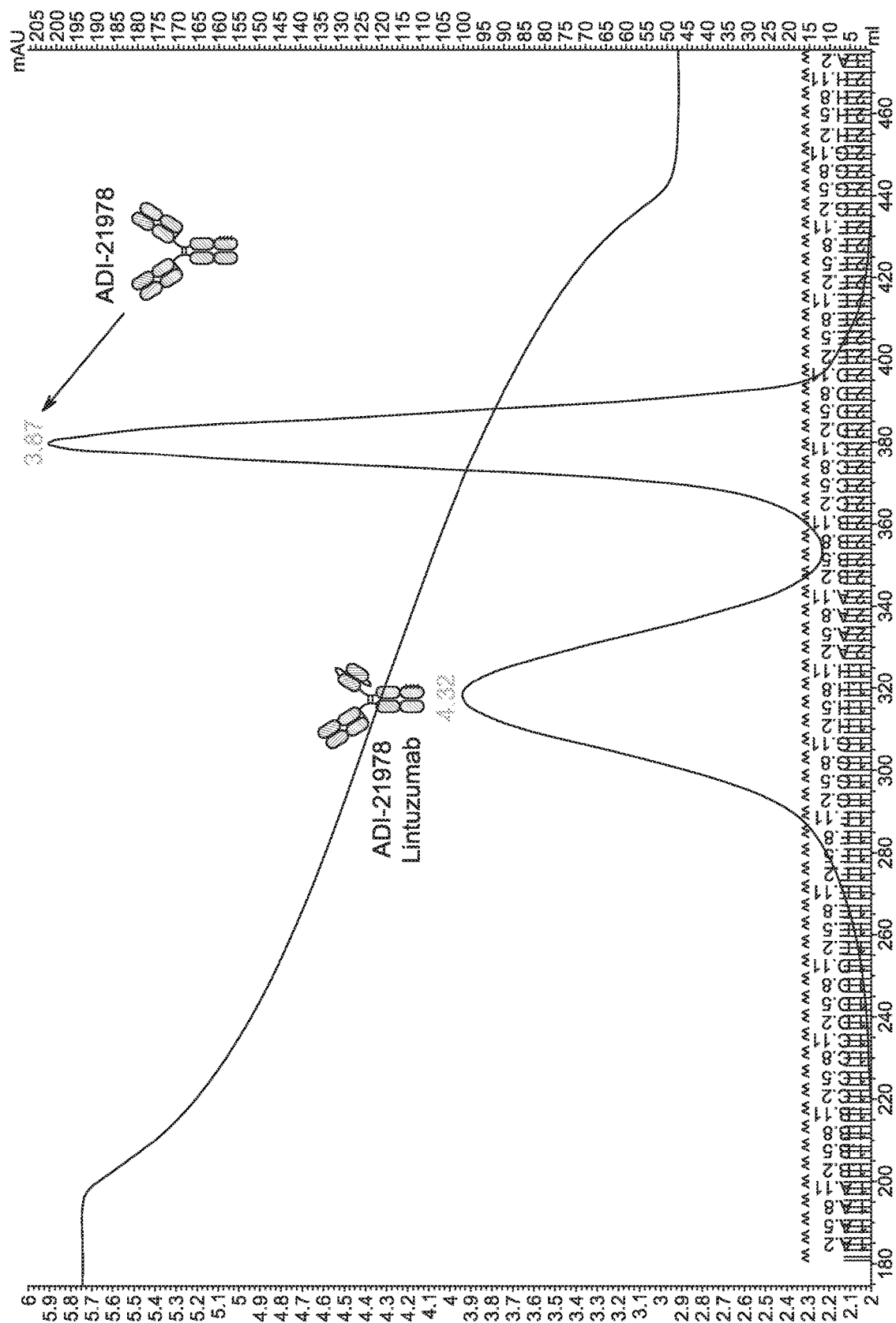
Figure 36C:
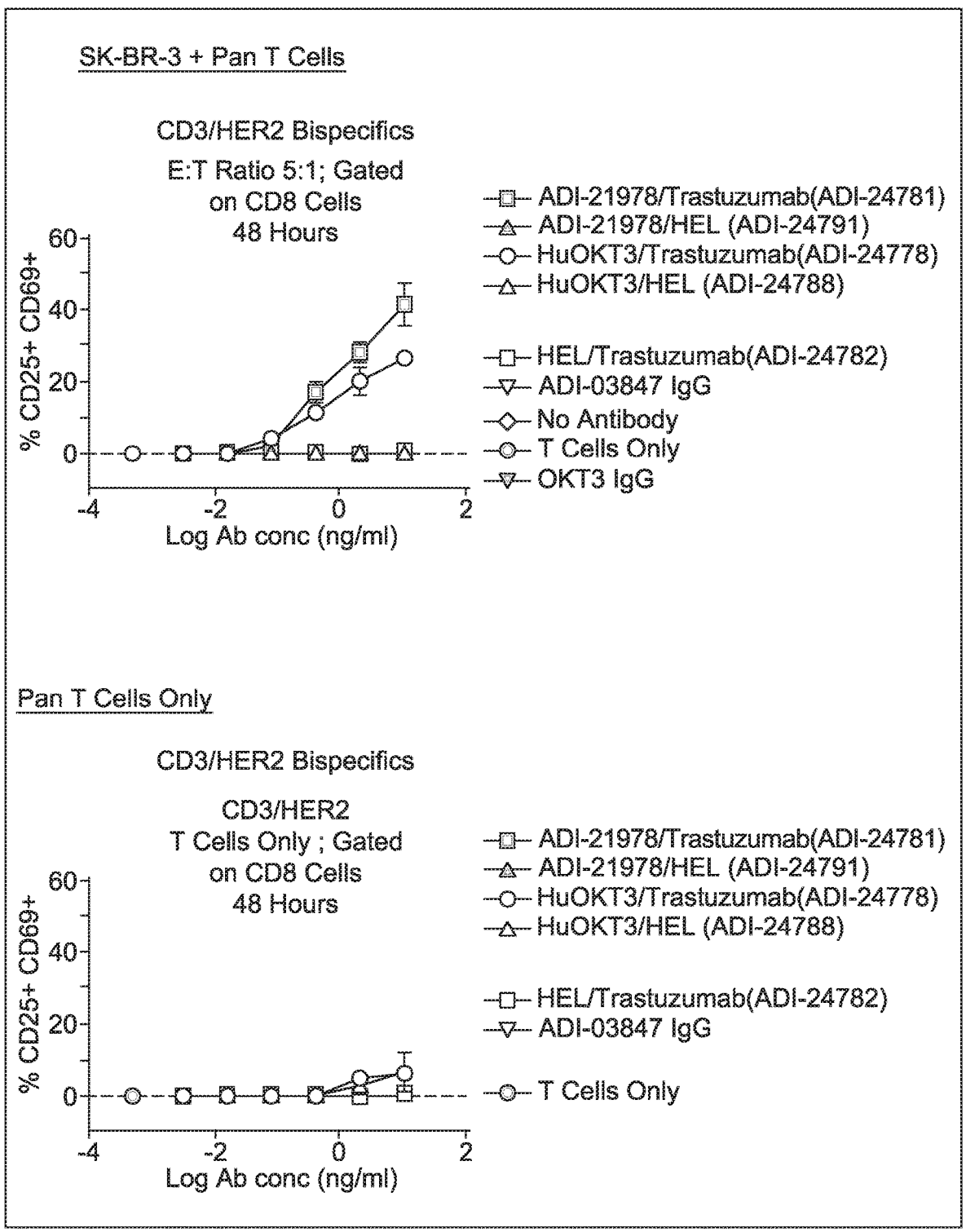

Literature tumor associated antigen (TAA) binders targeting CD33 (Lintuzumab) and HER2 (Trastuzumab) were selected for assembly of bispecific molecules for functional validation, along with a negative control HEL binding antibody, ADI-03847 (FIG. 36A). As a first step, antibodies were reformatted to scFv-Fc having the IgG4 isotype and stabilizing hinge mutation Ser228Phe, produced in HEK293ADI1, and purified by CaptureSelect FcXL (GE Healthcare LifeSciences). All scFv-Fc bound only the expected target antigen (see, e.g., FIG. 36A, bottom panel). Bispecific CD3×TAA antibodies were produced by co-transfection of HEK293ADI1 with both HC and the CD3 LC plasmids. Purification of heterodimer was achieved by pH gradient elution from POROS MabCapture A column, which was generally effective for resolving the heterodimer from the CD3 monospecific antibody (FIG. 36B). CD3/HER2 bispecifics and TAA control were tested for their ability to activate T cells in the presence and absence of HER2 expressing cells SK-BR-3 as determined by percentage CD25+CD69+T (CD8) cells upon incubation with increasing amounts of the tested antibodies (FIG. 36C). T cell activation was not observed in the absence of a HER2 binding arm except for a low level of activation observed with HuOKT3 (ADI-10390) as the CD3 arm. In the presence of target cells the ADI-21978/Trastuzumab and ADI-10390/Trastuzumab both activated T cells, but neither CD3 binder activated cells when paired with the HEL control arm.

Analysis of T-Cell Activation and Target Cell Killing.

Figure 37:
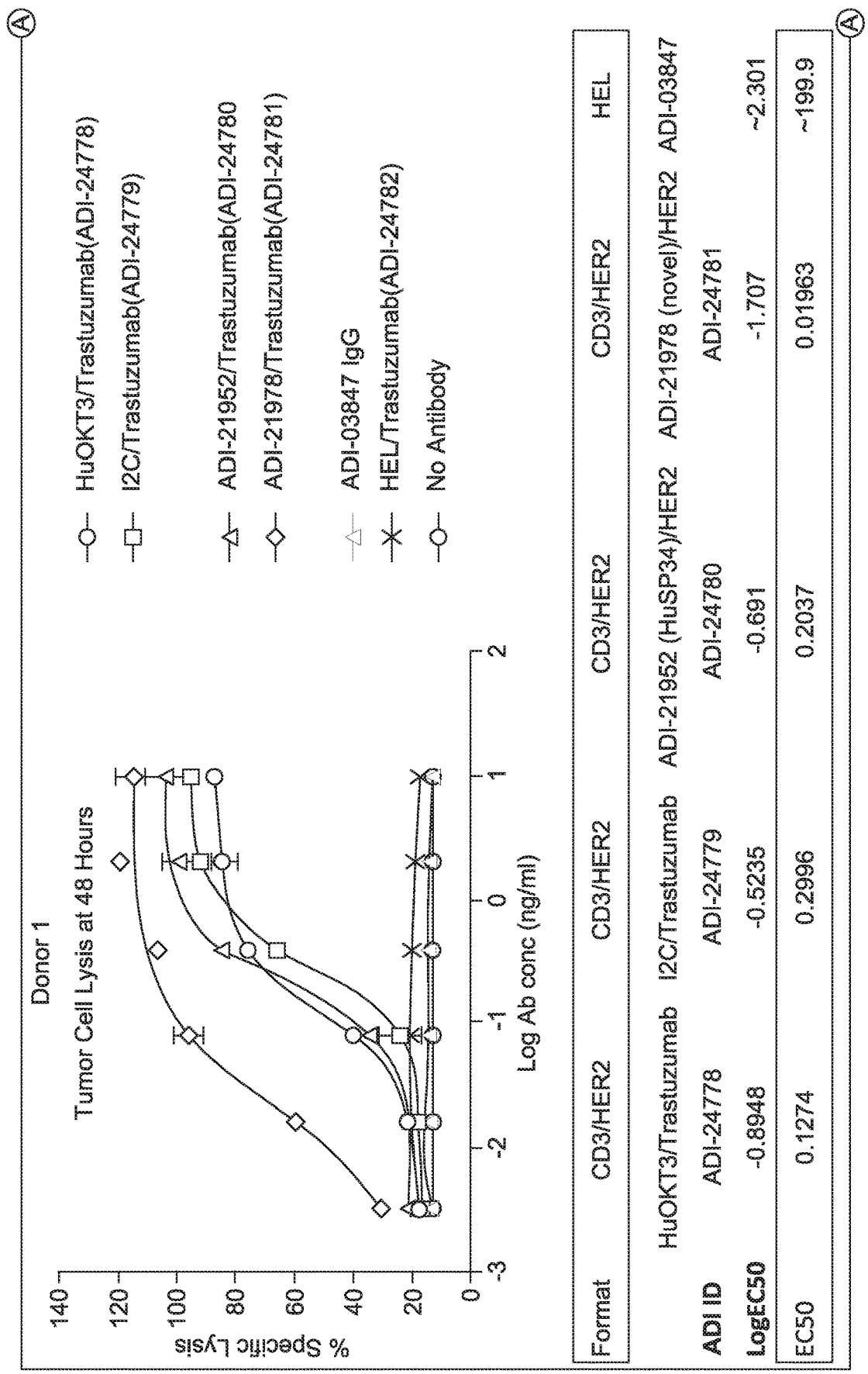
FIG. 37 shows an exemplary analysis of T-cell activation and target cell killing.
Figure 37:
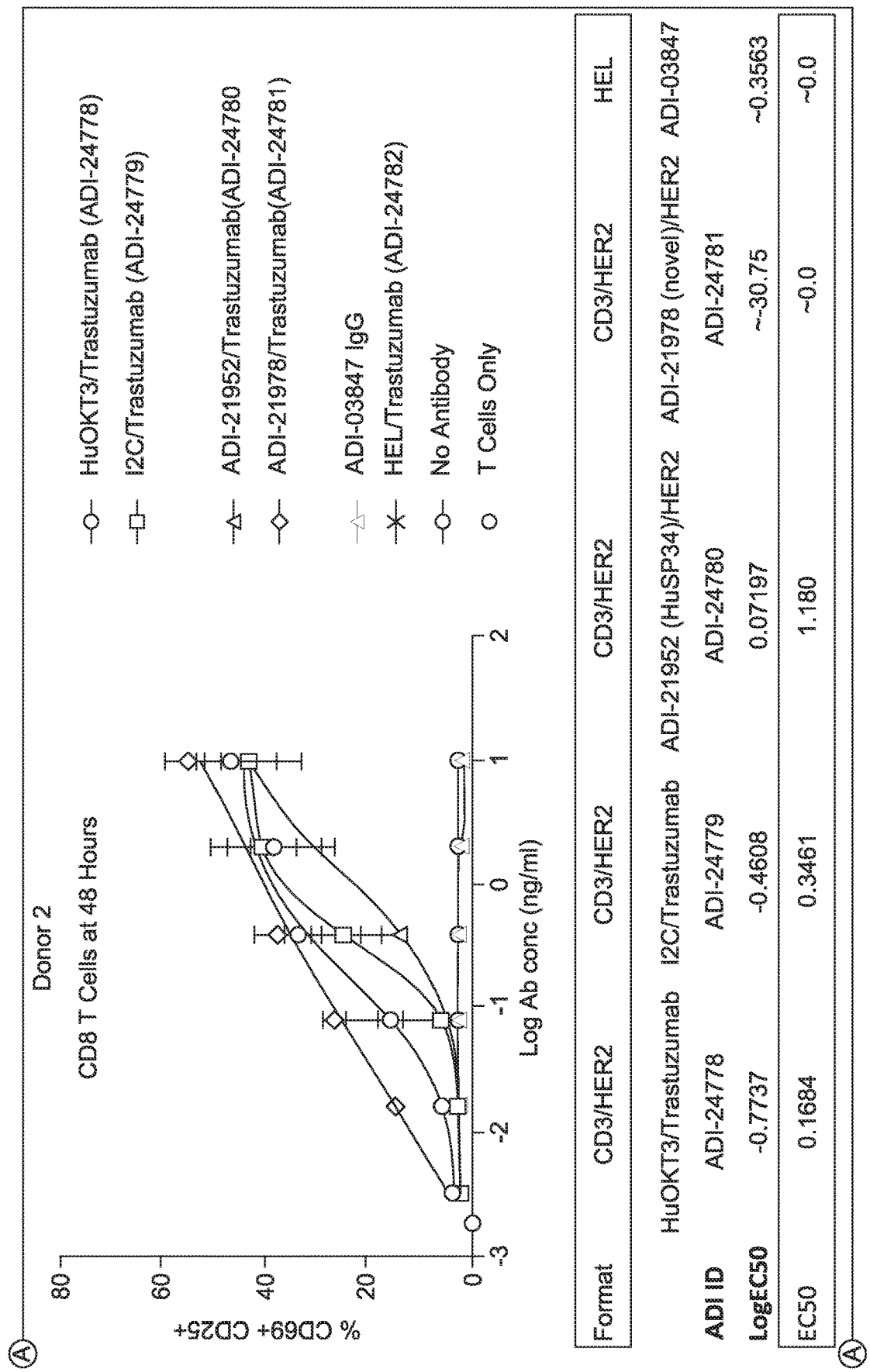

Next, CD3/HER2 and CD3/HEL bispecifics were tested in a redirected T cell cytotoxicity assay (RTCC). ADI-21952 (ADI-24780) and ADI-21978 (ADI-24781) elicited dose-dependent target cell killing by incubated T cell effector cells at a potency (EC50) that was approximate to or better than positive controls. In particular, ADI-21978/Trastuzumab bispecific elicited target cell killing potency in the picomolar (pM) range (See, e.g., FIG. 37).

Figure 38A:
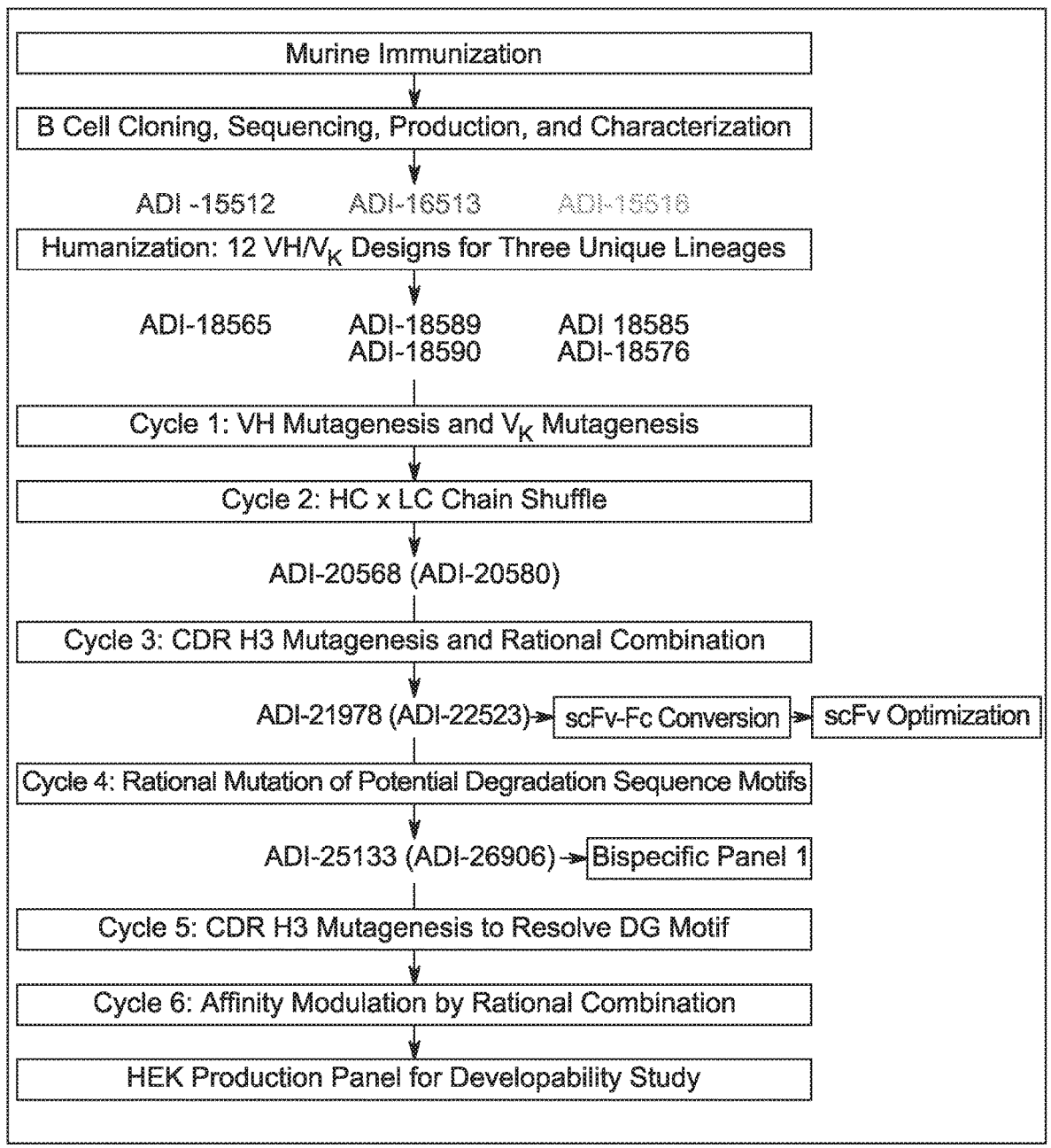
FIGS. 38A-38B show an exemplary schematic representation of the selection, humanization, and optimization procedures and clone lineages generated thereby as described in Examples 1 (A) and 2 (B).
Figure 38B:
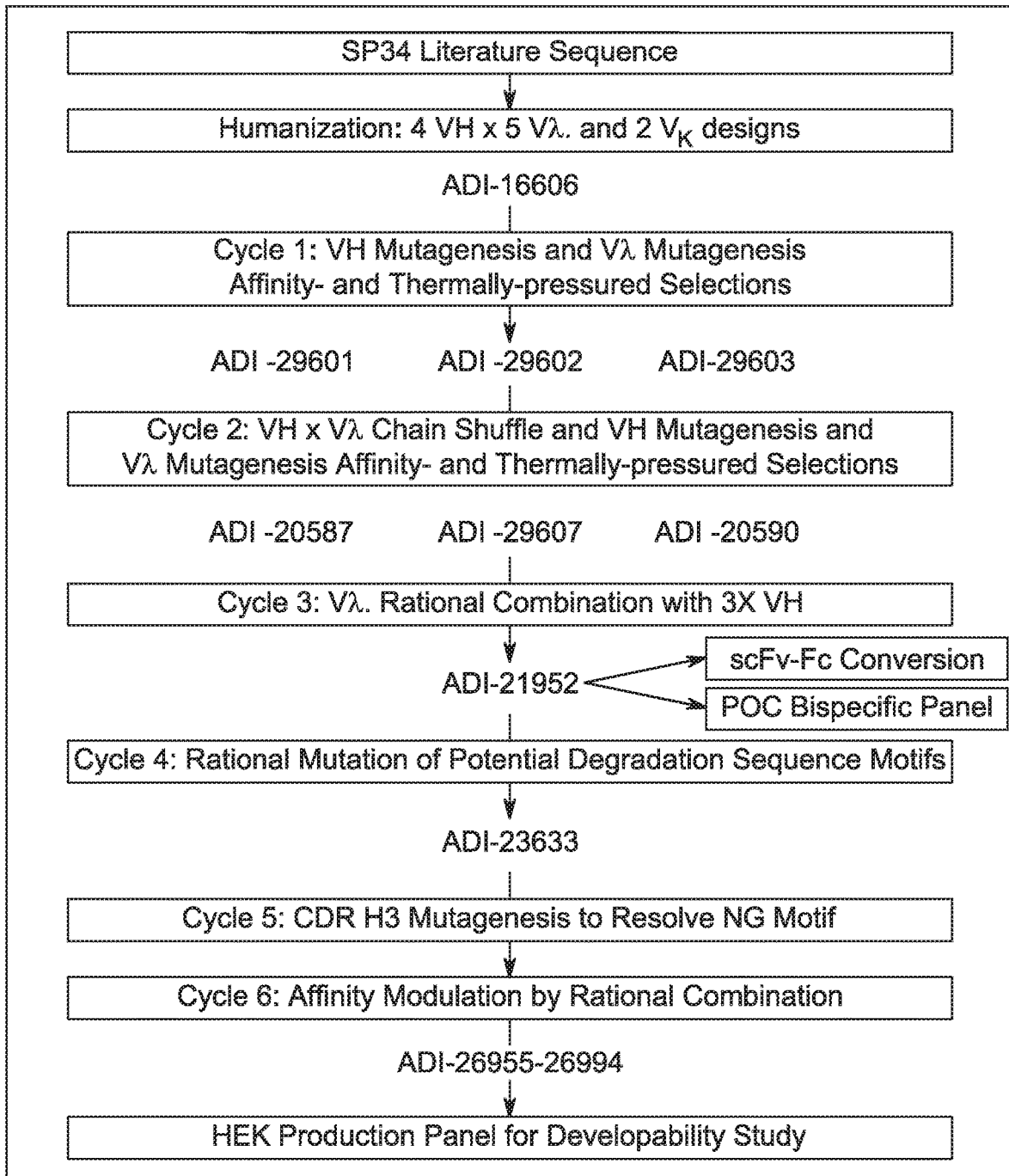

A schematic representation of the selection, humanization, and optimization procedures and clone lineages generated thereby as described in Examples 1 and 2 are provided in FIG. 38A and FIG. 38B, respectively.

Variants

Applicant has found that introducing certain variations into CDR sequences in CD3 antibodies or antigen-binding polypeptides may confer beneficial properties, such as increased target binding affinity, resistance to degradation (e.g., by proteases), and improved developability (e.g., a reduction in polyspecificity). For example, it has been found herein that introducing a "T" at position one of CDRH3 can lead to increased target binding affinity. In some embodiments, CD3 antibodies or antigen-binding polypeptides are provided in which a "T" is introduced at position 1 of CDRH3 and are characterized by increased binding affinity to CD3 antigens.

Also, Applicant has found herein that avoiding certain consecutive amino acid sequences in CDRH2 (e.g., "NG") and/or CDRH3 (e.g., "DG") can increase resistance to degradation. In some embodiments, CD3 antibodies or antigen-binding polypeptides are provided in which particular amino acids are avoided at certain positions (e.g., avoiding a "G", "N", or "D") in CDRH2 and/or CDRH3 and are characterized by resistance to degradation.

Additionally, Applicant has found herein that introduction of certain amino acids (e.g., "L" or "I") in CDRL3 can improve developability (e.g., as measured by AC-SINS, HIC Retention Time, or binding to Polyspecificity Reagents). In some embodiments, CD3 antibodies or antigen-binding polypeptide are provided that have "L" or "I" substituted and are characterized by improved developability scores.

Materials and Methods

In addition to the description provided above, the following Materials and Methods were employed in the Examples.

Hu and Cy CD3εδFc Heterodimer Antigen Production.

Recombinant heterodimeric CD3 Fc fusion antigens were produced in HEK 293 cells by co-transfection of plasmids encoding Hu CD3ε Fc (ectodomain, ECD, residues 22-126) and CD3δ Fc-HIS (ECD residues 22-100) or Cy CD3ε Fc (ECD residues 22-117) and CD3δ Fc-HIS (ECD residues 22-100) utilizing a heterologous signal peptide sequence. Chromatographic separations were performed on a computer controlled ÄKTA Avant 150 preparative chromatography system (GE Healthcare Life Sciences) equipped with an integrated conductivity sensor, enabling in-line salt concentration monitoring during the run. Clarified culture supernatants were purified by Ni Sepharose 6 Fast Flow (GE Healthcare Life Sciences), which removes the CD3εε Fc-HIS homodimer. CD3εδ Fc-HIS heterodimer was resolved from CD3δδ Fc-HIS homodimer by Mono Q 10/100 GL by a linear Tris-buffered KCl gradient at pH 8.5.

Peptides.

C-terminally biotinylated CD3ε N-terminal peptides were obtained from New England Peptide. All peptides were delivered with a purity of ≥95%. Peptides were designed based on the primary sequence of Hu CD3ε and the crystal structure of Hu CD3εδ bound to OKT3 (Kjer-Nielsen L. et al. PNAS 2004). The CD3εN27 peptide has the sequence H2N-QDGNEEMGSITQTPYQVSISGTTVILT[K/SCBiot(dPEG4)]-amide and the CD3εN13 peptide has the sequence H2N-QDGNEEMGGITQT[K/SCBiot(dPEG4)]-amide.

Antigen Biotinylation.

CD3 antigens were biotinylated using the EZ-Link Sulfo-NHS-Biotinylation Kit from Pierce. Goat anti-human F(ab')2 kappa-FITC (LC-FITC), Extravidin-PE (EA-PE) and streptavidin-633 (SA-633) were obtained from Southern Biotech, Sigma and Molecular Probes, respectively. Streptavidin MicroBeads and MACS LC separation columns were purchased from Miltenyi Biotec.

Cell Line Propagation and Cell Labeling Assays.

Human Jurkat CD3+ cells (ATCC TIB-152) and Jurkat CD3-cells (ATCC TIB-153) were obtained from ATCC. Cyno HSC-F cells were obtained from the NIH Non-human Primate Reagent Resource. All cell lines were cultured in RPMI 1640 GlutaMax media supplemented with 10% fetal bovine serum (FBS).

Cell labeling was conducted by aliquoting 100,000-200,000 cells per well in a 96-well assay plate. Cells were centrifugated at 500×g for 5 min at 4° C., then resuspended in 100 µl of 100 nM IgG and incubated at room temperature for 20 min. Cells were then washed in buffer (phosphate-buffered saline (PB S)/0.1% bovine serum albumin (BSA)) three times and resuspended in secondary reagent, typically goat anti-human R-PE (Southern Biotech). The plate was assayed on a FACSCanto (BD Biosciences) using an HTS sample injector. Flow cytometry data was analyzed for median fluorescence intensity in the R-PE channel.

Human PBMC Sourcing and Expansion.

Frozen human peripheral blood mononuclear cells (PBMC) were purchased from AllCells Inc. (Alameda, Calif.). Fresh peripheral blood mononuclear cells were purified from human whole blood from Scripps blood bank by Ficoll-Hypaque density gradient centrifugation.

PBMC were cultured in RPMI-10% FBS consisted of RPMI-1640 serum-free medium supplemented with 10% fetal bovine serum (Hyclone FBS; catalog number SH30071.031R, GE Healthcare, Logan, Utah), L-glutamine (catalog number 11875-093, ThermoFisher, Waltham, Mass.), 1% penicillin/streptomycin (catalog number 15070-063, ThermoFisher), 1 mM sodium pyruvate (catalog number 11360-070, ThermoFisher), 10 mM 4-(2-hydroxyethyl)-1-piperazineethanesulfonic acid (HEPES; catalog number 15630080, ThermoFisher), and 1× non-essential amino acid (catalog number 11140-50, ThermoFisher).

Previously frozen PBMC were quick thawed in 37° C. water bath and added to pre-warmed RPMI-10% FBS media. Cells were pelleted at 300×g, re-suspended in pre-warmed media and counted before use.

Peripheral Blood Mononuclear Cells (PBMC) Activation by CD3 Antibodies.

CD3 IgG and Fab were diluted in RPMI-10% FBS media to 2× final concentration (10 nM and 0.3 nM). Fifty microliters of 2× final concentration antibodies and 50 µL of donor PBMC at $2\times10^5$ cells/well were added to each well. Unstimulated control has RPMI-10% FBS media only, and positive control clone ADI-22523 and negative control ADI-03847 were also included in separate wells. Plates were incubated at 37° C. for 48 hours supernatant was harvested for cytokine analysis.

Measurement of T Cell Activation by Supernatant Cytokine.

After 48 hours of incubation, supernatant was collected for cytokine analysis by MesoScale discovery interferon-gamma tissue culture kit according to manufacturer's instruction. Supernatant was analyzed without dilution. Standard curve using recombinant cytokine was included in each plate for calculation of cytokine level in pg/ml.

Interferon gamma concentration (pg/mL) in supernatant was extrapolated using standard curve generated in MesoScale Discovery WorkBench software. Interferon gamma concentrations are listed as pg/ml. Antibody affinity data (Fab, IgG) to human CD3εδ was provided and are listed as Molar.

FACS Affinity Pressured Selection Methods.

Briefly, yeast cells (at least $\sim2\times10^7$ cells/labeling condition) were incubated with a volume of biotinylated antigen sufficient to represent a stoichiometric excess with respect to the average IgG presentation number. Antigen labeling conditions are 100 to 1 nM under equilibrium conditions, typically carried out for 20 min to several hours at room temperature in FACS wash buffer (phosphate-buffered saline (PB S)/0.1% bovine serum albumin (BSA)). After washing three times with wash buffer, yeast were then stained with secondary reagents anti-human light chain FITC conjugate (LC-FITC) diluted 1:100 and either streptavidin-633 (SA-633) diluted 1:500 or extravidin-phycoerythrin (EA-PE) diluted 1:50 for 15 min at 4° C. After washing twice with ice-cold wash buffer, the cell pellets were resuspended in wash buffer in a typical volume of at least 1 mL per $1\times10^7$ yeast and transferred to strainer-capped sort tubes. Sorting is performed using a FACS ARIA sorter (BD Biosciences) and sort gates were determined to select for binders. After the final round of sorting, yeast were plated and individual colonies picked for characterization.

FACS Thermal Pressured Selection Methods.

The parent antibody was diversified by error-prone PCR to derive an optimization library in yeast. This yeast library first proceeds through a positive antigen selection round to select for expressing binders, using CD3εN27. This enriched population then proceeded through a series of thermally pressured conditions ranging from ~50° C. up to 65° C. for 10 min with room temperature as a control. Optimally pressured conditions were gated on LC presentation (anti-human lambda PE) and antigen binding (SA-APC), reflecting the residual folded IgG competent to bind the selection reagents. Sorted cells are pelleted and the plasmids extracted using a commercial yeast plasmid purification kit (Zymo Research) in which the yeast cell walls are disrupted with Zymolase and the DNA is subsequently purified by a DNA mini-column. Plasmid DNA is then transformed into E. coli for amplification, followed by mini-prep isolation of the plasmid DNA with an E. coli plasmid purification kit (Qiagen). Plasmid DNA is then prepared for transformation into the appropriate yeast strain for subsequent cycles selection or sequencing and IgG production.

Error-Prone PCR Optimization.

Error-prone PCR-based mutagenesis of the heavy chain (VH) and/or light chain (VL) using standard molecular biology techniques introduced stochastic diversity. Briefly, mutagenic nucleotide analogues dPTP and 8-oxo-dGTP were incorporated into the VH and VL amplification process at 1 uM concentration to increase the base mis-incorporation frequency up to approx. 0.01 bp. The mutated PCR product was recombined in situ by homologous recombination with a linearized vector containing the HC or LC constant region sequences. This typically results in a library of $1\times10^{7-8}$ diversity. Affinity and expression co-pressures were applied by incubating the antigen antibody yeast complex at decreasing concentrations of antigen (equilibrium pressure) or with parental Fab competition (equilibrium and kinetic pressures) for varying amounts of time to select for the highest affinity antibodies on FACS over successive rounds of selection.

Oligonucleotide-Based CDR H3 Mutagenesis.

Discovered or previously optimized antibodies can progress through additional optimization by diversification of the CDR H3 sequence. To do so, the light chain variable region of the starting antibody is PCR amplified, and then, using yeast homologous recombination, is inserted into a yeast strain containing the light chain empty vector. This constitutes the parental light chain yeast strain. The heavy chain of the starting antibody is used as PCR input in combination with germline specific primers that generate a PCR product that contains from framework 1 through framework three of the heavy chain. This amplification is perform using the mutagenic nucleotide 8-oxo-dGTP to provide additional low levels of mutagenesis in the amplified heavy chain region. In order to create designed diversity in the CDR H3 region of the starting antibody, a library of CDR H3 oligos is generated/ordered (i.e. from IDT). The oligo pool is amplified with primers containing 5' tails that allow for germline specific recombination with the amplified FW1-FW3 region and the empty. A universal 3' primer is used for FW4. Alternatively, mutagenic PCR can be performed that incorporates 8-oxo-dGTP into a PCR reaction using germline specific 5' primers, the universal 3' primer and VH DNA. Once the LC strain, HC FW1-FW3 and diversified CDR H3-FW4 inputs have been generated, a three piece transformation is performed by introducing the two HC components along with a HC empty vector into the LC strain. Subsequently, the cells are grown out under selective pressure to ensure HC and LC components are present.

Antibody Yeast Production and Purification.

Yeast clones were grown to saturation and then induced for 48 h at 30° C. with shaking. After induction, yeast cells were pelleted and the supernatants were harvested for purification. IgGs were purified using a Protein A column and eluted with acetic acid, pH 2.0. Fab fragments were generated by papain digestion and purified over KappaSelect or CaptureSelect IgG-CH1 (GE Healthcare LifeSciences).

Antibody HEK Production and Purification.

Mammalian expression of IgG was done by sub-cloning antibodies into a new expression vector followed by transient transfection and expression in HEK293ADI1, a monoclonal cell line derived from HEK293 (DSMZ) selected for clump-free growth, growth rate, and transfectability. Briefly, expression vectors containing the antibody of interest were transfected by complexing with a transfection reagent followed by exposure to HEK cells for one hour followed by dilution of culture media to a final density of 4 million cells per mL. The cells were then cultured for 7 days with fresh feed media every 48 hours. After 7 days, the supernatant was collected following centrifugation and purification was performed using protein A. If necessary, a CHT column purification was added to reach >95% monomer.

Bispecific Antibody HEK Production and Purification.

IgG4 scFv-Fc molecules carrying the ProA non-binding His435→Arg, Tyr436→Phe ("RF") mutations were purified by CaptureSelect™ FcXL (GE HealthCare) and eluted with acetic acid pH 3.5.

Bispecific antibodies were expressed in HEK293ADI1 cells grown in shake flasks. To obtain clearance of the ProA non-binding RF homodimer, primary capture was performed using a Mab Select SuRE column, eluted with acetic acid, pH 3.5 and neutralized with 2M HEPES pH 8.0. Heterodimer was then isolated by a secondary purification on a POROS MabCapture A column, and linear gradient elution of 40 mM acetic acid, 500 mM NaCl from pH 6.0 to pH 3.0. Fractions were neutralized with 2M HEPES pH 8.0, pooled to avoid inclusion of aggregates appearing at the tail of the heterodimer peak, and analyzed by LCMS to ensure heterodimer purity.

ForteBio KD Measurements (Biolayer Interferometry; BLI).

ForteBio affinity measurements were performed generally as previously described (Estep, P., et al., High throughput solution-based measurement of antibody-antigen affinity and epitope binning. MAbs, 2013. 5(2): p. 270-8.). Briefly, ForteBio affinity measurements were performed by loading IgGs online onto AHQ sensors. Sensors were equilibrated off-line in assay buffer for 30 min and then monitored on-line for 60 seconds for baseline establishment. Sensors with loaded IgGs were exposed to 100 nM antigen for 5 min, afterwards they were transferred to assay buffer for 5 min for off-rate measurement. Kinetics was analyzed using the 1:1 binding model.

BiaCore KD Measurements (Surface Plasmon Resonance; SPR).

Biosensor analysis was conducted at 25° C. in a HBS-EP buffer system (10 mM HEPES pH 7.3, 150 mM NaCl, 3 mM EDTA, 0.05% Surfactant P20) using a Biacore 8K optical biosensor docked with a CM5 sensor chip (GE Healthcare, Marlboro, Mass.). The sample hotel was maintained at 10° C. Goat anti-human IgG capture antibody (Jackson ImmunoResearch Laboratories, Inc., West Grove, Pa.; 109-005-098) was immobilized (11700+/−400 RU) to both flow cells of the sensor chip using standard amine coupling chemistry. This surface type provided a format for reproducibly capturing fresh analysis antigen after each regeneration step. Flow cell 2 was used to analyze captured antigen (35.7+/−0.8 RU) while flow cell 1 was used as a reference flow cell. Fab concentrations ranging from 100 to 0.412 nM (3-fold dilutions) were prepared in running buffer. Each of the Fab sample concentrations were run as a single replicate. Two blank (buffer) injections also were run and used to assess and subtract system artifacts. The association and dissociation phases for all Fab concentrations were monitored for 180 s each, at a flow rate of 30 µL/min. The surface was regenerated with 10 mM glycine, pH 1.5 for 30 s, at a flow rate of 30 µL/min. The data was aligned, double referenced, and fit using Biacore 8K Evaluation Software, version 1.0.

Octet Red384 Epitope Binning/Ligand Blocking.

Epitope binning/ligand blocking was performed using a standard sandwich format cross-blocking assay. Control anti-target IgG was loaded onto AHQ sensors and unoccupied Fc-binding sites on the sensor were blocked with an irrelevant human IgG1 antibody. The sensors were then exposed to 100 nM target antigen followed by a second anti-target antibody or ligand. Data was processed using ForteBio's Data Analysis Software 7.0. Additional binding by the second antibody or ligand after antigen association indicates an unoccupied epitope (non-competitor), while no binding indicates epitope blocking (competitor or ligand blocking).

Size Exclusion Chromatography.

A TSKgel SuperSW mAb HTP column (22855) was used for fast SEC analysis of yeast and mammalian produced mAbs at 0.4 mL/min with a cycle time of 6 min/run. 200 mM Sodium Phosphate and 250 mM Sodium Chloride was used as the mobile phase.

Dynamic Scanning Fluorimetry (DSF).

10 µL of 20× Sypro Orange is added to 20 µL of 0.2-1 mg/mL mAb or Fab solution. A RT-PCR instrument (BioRad CFX96 RT PCR) is used to ramp the sample plate temperature from 40 to 95° C. at 0.5° C. increments, with 2 min equilibrate at each temperature. The negative of first derivative for the raw data is used to extract Tm.

PSR Preparation.

Polyspecific reactivity reagent (PSR) was prepared as described in, e.g., WO 2014/179363 and Xu et al., mAbs, 2013. In brief, 2.5 liters CHO-S cells were used as starting material. The cells were pelleted at 2,400×g for 5 min in 500 mL centrifuge bottles filled to 400 mL. Cell pellets were combined and then resuspended in 25 ml Buffer B and pelleted at 2,400×g for 3 min. The buffer was decanted and the wash repeated one time. Cell pellets were resuspend in 3× the pellet volume of Buffer B containing 1× protease inhibitors (Roche, Complete, EDTA-free) using a polytron homogenizer with the cells maintained on ice. The homogenate was then centrifuged at 2,400×g for 5 min and the supernatant retained and pelleted one additional time (2,400×g/5 min) to ensure the removal of unbroken cells, cell debris and nuclei; the resultant supernatant is the total protein preparation. The supernatant was then transferred into two Nalgene Oak Ridge 45 mL centrifuge tubes and pelleted at 40,000×g for 40 min at 4° C. The supernatants containing the Separated Cytosolic Proteins (SCPs) were then transferred into clean Oak Ridge tubes, and centrifuged at 40,000×g one more time. In parallel, the pellets containing the membrane fraction (EMF) were retained and centrifuged at 40,000 for 20 min to remove residual supernatant. The EMF pellets were then rinsed with Buffer B. 8 mL Buffer B was then added to the membrane pellets to dislodge the pellets and transfer into a Dounce Homogenizer. After the pellets were homogenized, they were transferred to a 50 mL conical tube and represented the final EMF preparation.

One billion mammalian cells (e.g. CHO, HEK293, Sf9) at ~$10^6$-$10^7$ cells/mL were transferred from tissue culture environment into 4×250 mL conical tubes and pelleted at 550×g for 3 min. All subsequent steps were performed at 4° C. or on ice with ice-cold buffers. Cells were washed with 100 mL of PBSF (1×PBS+1 mg/mL BSA) and combined into one conical tube. After removing the supernatant, the cell pellet was then re-suspended in 30 mL Buffer B (50 mM HEPES, 0.15 M NaCl, 2 mM $CaCl_2$, 5 mM KCl, 5 mM $MgCl_2$, 10% Glycerol, pH 7.2) and pelleted at 550×g for 3 min. Buffer B supernatant was decanted and cells re-suspended in 3× pellet volume of Buffer B plus 2.5× protease inhibitor (Roche, cOmplete, EDTA-free). Protease inhibitors in Buffer B were included from here on forward. Cells were homogenized four times for 30 sec pulses (Polyton homogenizer, PT1200E) and the membrane fraction was pelleted at 40,000×g for 1 hour at 4° C. The pellet is rinsed with 1 mL Buffer B; the supernatant is retained and represents the s. The pellet is transferred into a Dounce homogenizer with 3 mL of Buffer B and re-suspended by moving the pestle slowly up and down for 30-35 strokes. The enriched membrane fraction (EMF) is moved into a new collection tube, rinsing the pestle to collect all potential protein. Determine the protein concentration of the purified EMF using the Dc-protein assay kit (BioRad). To solubilize the EMF, transfer into Solubilization Buffer (50 mM HEPES, 0.15 M NaCl, 2 mM $CaCl_2$, 5 mM KCl, 5 mM $MgCl_2$, 1% n-Dodecyl-b-D-Maltopyranoside (DDM), 1× protease inhibitor, pH 7.2) to a final concentration of 1 mg/mL. Rotate the mixture overnight at 4° C. rotating followed by centrifugation in a 50 mL Oak Ridge tube (Fisher Scientific, 050529-ID) at 40,000×g for 1 hour. Collect the supernatant which represents the soluble membrane proteins (SMPs) and quantify the protein yield as described above.

For biotinylation, prepare the NHS-LC-Biotin stock solution according to manufacturer's protocol (Pierce, Thermo Fisher). In brief, 20 µl of biotin reagent is added for every 1 mg of EMF sample and incubated at 4° C. for 3 hours with gentle agitation. Adjust the volume to 25 mL with Buffer B and transfer to an Oak Ridge centrifuge tube. Pellet the biotinylated EMF (b-EMF) at 40,000×g for 1 hour, and rinse two times with 3 mL of Buffer C (Buffer B minus the glycerol) without disturbing the pellet. Remove the residual solution. Re-suspended the pellet with a Dounce homogenizer in 3 mL of Buffer C as described previously. The re-suspended pellet now represents biotinylated EMF (b-EMF). Solubilized as described above to prepare b-SMPs.

PSR Binding Analyses.

Assays were performed generally as described in, e.g., Xu et al. To characterize the PSR profile of monoclonal antibodies presented on yeast, two million IgG-presenting yeast were transferred into a 96-well assay plate and pellet at 3000×g for 3 min to remove supernatant. Re-suspend the pellet in 50 µl of freshly prepared 1:10 dilution of stock b-PSRs and incubate on ice for 20 minutes. Wash the cells twice with 200 µl of cold PBSF and pellet re-suspended in 50 µl of secondary labeling mix (Extravidin-R-PE, anti-human LC-FITC, and propidium iodide). Incubate the mix on ice for 20 minutes followed by two washes with 200 ul ice-cold PBSF. Re-suspend the cells in 100 µl of ice-cold PBSF and run the plate on a FACSCanto (BD Biosciences) using HTS sample injector. Flow cytometry data was analyzed for mean fluorescence intensity in the R-PE channel and normalized to proper controls in order to assess non-specific binding. Numerous methods for presentation or display of antibodies or antibody fragments on the surface of yeast have been described previously, all of which are consistent with this protocol (Blaise et al., 2004, Boder and Wittrup, 1997, Kuroda and Ueda, 2011, Orcutt and Wittrup, 2010, Rakestraw et al., 2011, Sazinsky et al., 2008, Tasumi et al., 2009, Vasquez et al., 2009).

Baculovirus Particle Assay (BVP).

BVPs (BlueSky Biotech) were incubated on ELISA plates by adding 50 µl of 1:1 BVP stock: 50 mM sodium carbonate (pH 9.6) per well and placed at 4° C. for 16-24 h. The next day, unbound BVPs were aspirated from the wells. All remaining steps were performed at room temperature (22° C.). One hundred microliters of blocking buffer (PBS with 0.5% BSA) was added and let incubate for 1 h prior to three washes with 100 µl of PBS. Next, 50 µl of 1 µM primary antibodies (i.e. test antibodies) in blocking buffer was added to the wells and incubated for 1 h followed by six washes with 100 µl of PBS. Fifty microliters of anti-Human-IgG-HRP (Promega W4038, prepared in PBS) was added to the wells and incubated for 1 h followed by six washes as before. Finally, 50 µl of TMB substrate (Fisher Scientific, 34021) was added to each well and incubated for $10^{-15}$ min. The reactions were stopped by adding 50 µl of 2 M sulfuric acid to each well. The absorbance was read at 450 nm and BVP score determined by normalizing absorbance by control wells with no test antibody.

ForteBio Kinetics.

FortBio Octet HTX instruments were used in 12 channel mode (8 sensors per channel, 96 sensors per experiment) with either AHC, SA, or AHQ sensors. Instrumentation was driven by manufacturer supplied software (versions 8.2 and 9.0). Sample names and concentrations were input into the plate data page, and sensor associated proteins were identified in the "information" column on the sensor data page. Kinetic experiments are collected with either a 90 or 180 s baseline, 180 s association phase, and 180 s dissociation phase. Binning experiments were collected in 5 steps: 90 s of baseline1, 90 s of a sensor binding check with the secondary binder, 90 s of baseline2, 180 s of association, and 180 s of dissociation in the well containing the secondary mAb. All files were saved into a shared network drive with a naming convention that identifies the format of the experiment.

HIC.

IgG1 samples were buffer exchanged into 1 M ammonium sulfate and 0.1 M sodium phosphate at pH 6.5 using a Zeba 40 kDa 0.5 mL spin column (Thermo Pierce, cat #87766). A salt gradient was established on a Dionex ProPac HIC-10 column from 1.8 M ammonium sulfate, 0.1 M sodium phosphate at pH 6.5 to the same condition without ammonium sulfate. The gradient ran for 17 min at a flow rate of 0.75 ml/min. An acetonitrile wash step was added at the end of the run to remove any remaining protein and the column was re-equilibrated over 7 column volumes before the next injection cycle. Peak retention times were monitored at A280 absorbance and concentrations of ammonium sulfate at elution were calculated based on gradient and flow rate.

LCMS.

mAb samples were reduced by DTT, followed by middle down LCMS analysis on a Bruker maXis4G mass spectrometer coupled with an Agilent 1100 HPLC (Agilent). A POROS R2 10 μm (2.1×30 mm) reversed phase column was used to remove salt in the samples. A fast LC flow at 2 mL/min allows the separation between sample and salt and elution of samples and regeneration of column to finish within a 2.1 min cycle. A T-junction is used to deliver only 0.15 mL/min sample flow into the mass spectrometer for sample analysis. The Bruker maXis 4G mass spectrometer was run in positive ion mode with detection in the range of 750 to 2500 m/z. The remaining source parameters were set as follows; the capillary was set at 5500V, the Nebulizer at 4.0 Bar, dry gas at 4.0 l/min, and dry temp set at 200° C.

The MS spectra were analyzed using Bruker Data Analysis version 4.1 and the deconvolution was accomplished using maximum entropy deconvolution with a mass range of 20 to 30 kDa.

IL2 Secretion.

Coat a flat-bottom 96-well culture plate (Thermo Scientific, 446612) with 200 ul per well of anti-CD3 antibody at 10 μg/mL concentration in sterile DPBS; cover with lid and incubate overnight at 4° C. Just before adding cells the following day, wash the 96-well culture plate 3 times with 200 μl of ice-cold sterile DPBS. In parallel, prepare the cells. Measure the cell density, and calculate the total number of CD3+ and CD3-cells to achieve $1 \times 10^6$ cells/well. Aliquot the required amount of cells into a 50 mL conical tube, and then wash cells 3× in 50 mL of warm (37° C.) RPMI 1640 GlutaMAX (Gibco, 61870-127). Resuspend the cells in warm culture media containing soluble anti-CD28 antibody (BioLegend) at a concentration of 2 μg/mL, for a cell density of $1 \times 10^7$ cells/mL. Dispense 100 ul, containing $1.0 \times 10^6$ cells, per well onto anti-CD3-coated cell culture plate. Cover the plate with the hard plastic plate lid and incubate in stationary incubator at 37° C. for 14-16 h. The next day, harvest the contents of each well by carefully pipetting, and then transfer the cells and supernatants to a 96-well plate (Thermo Scientific, 264623). Centrifuge the plate at 500×g for 3 min to pellet the cells. Without disturbing the pellet, carefully transfer the supernatant to a new Eppendorf tube or Canto plate. Gather and prepare all reagents to be used in the MSD kit (Meso Scale Discovery IL-2 V-Plex Kit, K151QQD-2). Serially dilute the IL-2 calibrator with Diluent 2 to generate a set of 7 points for a standard curve, in addition to a zero sample containing only Diluent 2. Transfer 50 μl of each standard to each well in one column of an MSD plate, ensuring the entire bottom of the well is coated. Transfer 50 μl of sample from each well to the MSD plate. Ensure the liquid completely coats the entire bottom of each well, including both electrodes. Cover the MSD plate with clear film, and incubate it on a plate shaker for 2 h at 700 rpm at room temperature (22-25° C.). After 2 h, flick and blot the plate on a paper towel, and wash three times with 150 ul wash buffer, flicking to get rid of buffer between washes. After the final wash, blot the plate on a paper towel to remove any remaining buffer. Add 25 μl of IL-2 detection antibody solution to the bottom of each well. Cover the MSD plate with clear film, and incubate it on a plate shaker for 1-2 h at 700 rpm at room temperature. After 2 h, flick and blot the plate on a paper towel, and then wash three times with 150 ul wash buffer. Add 150 μl of 2× read buffer with surfactant to each well, and analyze the plate (or selected wells of the plate) on the MSD instrument.

An informal sequence listing is provided in Table 2, below. The informal sequence listing provides the following sixteen (16) sequence elements contained in each of 405 antibodies, identified as described above and designated as Antibody Numbers (Ab #) 1 through 405, in the following order:

Heavy chain variable region ("HC") nucleic acid sequence
Heavy chain variable region ("HC") amino acid sequence
Heavy chain variable region CDR H1 ("H1") amino acid sequence
Heavy chain variable region CDR H1 ("H1") nucleic acid sequence
Heavy chain variable region CDR H2 ("H2") amino acid sequence
Heavy chain variable region CDR H2 ("H2") nucleic acid sequence
Heavy chain variable region CDR H3 ("H3") amino acid sequence
Heavy chain variable region CDR H3 ("H3") nucleic acid sequence
Light chain variable region ("LC") nucleic acid sequence
Light chain variable region ("LC") amino acid sequence
Light chain variable region CDR L1 ("Li") amino acid sequence
Light chain variable region CDR L1 ("L1") nucleic acid sequence
Light chain variable region CDR L2 ("L2") amino acid sequence
Light chain variable region CDR L2 ("L2") nucleic acid sequence
Light chain variable region CDR L3 ("L3") amino acid sequence
Light chain variable region CDR L3 ("L3") nucleic acid sequence Lengthy table referenced here

US11542330-20230103-T00001

Please refer to the end of the specification for access instructions.

Lengthy table referenced here

US11542330-20230103-T00002

Please refer to the end of the specification for access instructions.

Lengthy table referenced here

US11542330-20230103-T00003

Please refer to the end of the specification for access instructions.

Further embodiments are enumerated in clauses below.

1. An antibody comprising an anti-cluster of differentiation three (CD3) binding domain, wherein said antibody displays an enhanced developability profile relative to one or more of: trastuzumab; (Herceptin®); lintuzumab; blinatumomab (Blincyto®); and Mab 364, Mab366, Mab 367, Mab 368, Mab 369, Mab 370, or Mab 22, as provided in Table 2.

2. The antibody according to Clause 1, wherein the enhanced developability profile is obtained by performing a PSR assay; an SCP assay; AS-CINS; a BVP assay; an ELISA; a DSF assay; a Tm assay; a HIC assay; a CIC assay; or combinations thereof.

3. An antibody comprising a CD3 binding domain, wherein said antibody displays a developability score of: between about 0 MFI and about 500 MFI; between about 0

MFI and about 450 MFI; between about 0 MFI and about 400 MFI; between about 0 MFI and about 350 MFI; between about 0 MFI and about 300 MFI; between about 0 MFI and about 250 MFI; between about 0 MFI and about 200 MFI; between about 0 MFI and about 150 MFI; between about 0 MFI and about 100 MFI; between about 0 MFI and about 50 MFI; between about 200 MFI and 500 MFI; between about 200 MFI and about 450 MFI; between about 200 MFI and about 400 MFI; between about 200 MFI and about 350 MFI; between about 200 MFI and about 300 MFI; between about 200 MFI and about 250 MFI; between about 100 MFI and about 450 MFI; between about 100 MFI and about 400 MFI; between about 100 MFI and about 350 MFI; between about 100 MFI and about 300 MFI; between about 100 MFI and about 250 MFI; between about 100 MFI and about 200 MFI; or between about 100 MFI and about 150 MFI.

4. The antibody according to Clause 3, wherein the developability score is obtained by performing a PSR assay, an SCP assay AS-CINS; a BVP assay; an ELISA; a DSF assay; a Tm assay; a HIC assay; a CIC assay; or combinations thereof.

5. An antibody comprising a CD3 binding domain, wherein said antibody displays a normalized developability score of between about 0.0 and about 0.6; between about 0.0 and about 0.57; between about 0.0 and about 0.55; between about 0.0 and about 0.53; between about 0.0 and about 0.51; between about 0.0 and about 0.49; between about 0.0 and about 0.47; between about 0.0 and about 0.45; between about 0.0 and about 0.43; between about 0.0 and about 0.41; between about 0.0 and about 0.39; between about 0.0 and about 0.37; between about 0.0 and about 0.35; between about 0.0 and about 0.33; between about 0.0 and about 0.31; between about 0.0 and about 0.29; between about 0.0 and about 0.27; between about 0.0 and about 0.25; between about 0.0 and about 0.23; between about 0.0 and about 0.21; between about 0.0 and about 0.19; between about 0.0 and about 0.17; between about 0.0 and about 0.15; between about 0.0 and about 0.13; between about 0.0 and about 0.11; between about 0.0 and about 0.09; between about 0.0 and about 0.07; or between about 0.0 and about 0.05.

6. An antibody comprising a CD3 binding domain, wherein said antibody elicits T cell activation or T cell killing while displaying a decreased propensity to elicit cytokine production to levels capable of inducing cytokine release syndrome.

7. An antibody comprising a CD3 binding domain, wherein said antibody elicits T cell activation or T cell killing while displaying a decreased propensity to elicit cytokine production to levels capable of inducing cytokine release relative to that observed one or more of: trastuzumab; (Herceptin®); lintuzumab; blinatumomab (Blincyto®); and Mab 364, Mab366, Mab 367, Mab 368, Mab 369, Mab 370, or Mab 22, as provided in Table 2.

8. The antibody of Clause 6 or Clause 7, wherein the T cell activation, T cell killing, and/or cytokine production is assessed by performing a cell-based assay.

9. The antibody of Clause 8, wherein the T cell activation, T cell killing, and/or cytokine production is assessed by performing a T-cell activation assay, a T cell redirected target cell killing assay, and cytokine production level assay, wherein each assay comprises incubating PBMCs with the antibody.

10. The antibody of Clause 9, wherein the T cell redirected target cell killing assay further comprises incubating the PBMCs and the antibody with target cells expressing a target antigen other than CD3.

11. The antibody of any one of Clauses 6 through 10, wherein at least one cytokine for which cytokine production levels are measured is selected from the group consisting of: Interleukin 6 (IL-6); Interleukin 12 (IL-12); tumor necrosis factor alpha (TNFa); (TGFb); Interleukin-2 (IL-2); and Interferon gamma (IFNg).

12. The antibody of any one of Clauses 6 through 11, wherein IFNg production levels are measured.

13. The antibody of any one of Clauses 6 through 13, wherein the cytokine production levels constitute a cytokine release syndrome (CRS) risk profile.

14. The antibody of any one of Clauses 6 through 13 wherein the production levels constitute a cytokine release syndrome risk profile that is indicative of decreased risk of eliciting cytokine release syndrome (CRS).

15. The antibody of any one of Clauses 6 through 14 wherein the cytokine production levels constitute a cytokine release syndrome risk profile that is indicative of decreased risk of eliciting cytokine release syndrome (CRS) when compared to the cytokine release syndrome risk profile assessed for one or more of: trastuzumab; (Herceptin®); lintuzumab; blinatumomab (Blincyto®); and Mab 364, Mab366, Mab 367, Mab 368, Mab 369, Mab 370, or Mab 22, as provided in Table 2.

16. An antibody comprising a CDRH3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH3 selected from the group consisting of the CDRH3s of Mabs 1 through 21, 23 through 222, 224 through 363, and 371 through 405 as provided in Table 2; with the proviso that the CDRH3 is not 100% identical to the CDRH3 of any of Mabs 223, 364, 365, 366, 367, 368, 369, or 370 as provided in Table 2.

17. An antibody comprising a CDRH2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH2 selected from the group consisting of the CDRH2s of Mabs 1 through 21, 23 through 222, 224 through 363, and 371 through 405 as provided in Table 2; with the proviso that the CDRH2 is not 100% identical to the CDRH2 of any of Mabs 223, 364, 365, 366, 367, 368, 369, or 370 as provided in Table 2.

18. An antibody comprising a CDRH1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH1 selected from the group consisting of the CDRH1s of Mabs 1 through 21, 23 through 222, 224 through 363, and 371 through 405 as provided in Table 2; with the proviso that the CDRH1 is not 100% identical to the CDRH1 of any of Mabs 223, 364, 365, 366, 367, 368, 369, or 370 as provided in Table 2.

19. An antibody comprising a CDRL3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL3 selected from the group consisting of the CDRL3s of Mabs 1 through 21, 23 through 222, 224 through 363, and 371 through 405 as provided in Table 2; with the proviso that the CDRL3 is not 100% identical to the CDRL3 of any of Mabs 223, 364, 365, 366, 367, 368, 369, or 370 as provided in Table 2.

20. An antibody comprising a CDRL2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL2 selected from the group consisting of the CDRL2s of Mabs 1 through 21, 23 through 222, 224 through 363, and 371 through 405 as provided in Table 2; with the proviso that the CDRL2 is not 100% identical to the CDRL2 of any of Mabs 223, 364, 365, 366, 367, 368, 369, or 370 as provided in Table 2.

21. An antibody comprising a CDRL1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL1 selected from the group consisting of the CDRL1s of Mabs 1 through 21, 23 through 222, 224 through 363, and 371 through 405 as provided in Table 2; with the proviso that the CDRL1 is not 100% identical to the CDRL1 of any of Mabs 223, 364, 365, 366, 367, 368, 369, or 370 as provided in Table 2.

22. An antibody comprising a heavy chain (HC) that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; an HC selected from the group consisting of the HCs of Mabs 1 through 21, 23 through 222, 224 through 363, and 371 through 405 as provided in Table 2; with the proviso that the HC is not 100% identical to the HC of any of Mabs 223, 364, 365, 366, 367, 368, 369, or 370 as provided in Table 2.

23. An antibody comprising a light chain (LC) that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; an LC selected from the group consisting of the LCs of Mabs 1 through 21, 23 through 222, 224 through 363, and 371 through 405 as provided in Table 2; with the proviso that the LC is not 100% identical to the LC of any of Mabs 223, 364, 365, 366, 367, 368, 369, or 370 as provided in Table 2.

24. An antibody comprising:

A) a CDRH3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH3 selected from the group consisting of the CDRH3s of Mabs 1 through 21, 23 through 222, 224 through 363, and 371 through 405 as provided in Table 2;

B) a CDRH2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH2 selected from the group consisting of the CDRH2s of Mabs 1 through 21, 23 through 222, 224 through 363, and 371 through 405 as provided in Table 2; and C) a CDRH1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH1 selected from the group consisting of the CDRH1s of Mabs 1 through 21, 23 through 222, 224 through 363, and 371 through 405 as provided in Table 2; with the proviso that the neither the CDRH3, CDRH2, nor the CHRH1 is 100% identical to the CHRH3, CDRH2, or CDRH1, respectively, of any of Mabs 223, 364, 365, 366, 367, 368, 369, or 370 as provided in Table 2.

25. An antibody comprising:

A) a CDRL3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL3 selected from the group consisting of the CDRL3s of Mabs 1 through 21, 23 through 222, 224 through 363, and 371 through 405 as provided in Table 2;

B) a CDRL2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL2 selected from the group consisting of the CDRL2s of Mabs 1 through 21, 23 through 222, 224 through 363, and 371 through 405 as provided in Table 2; and C) a CDRL1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL1 selected from the group consisting of the CDRL1s of Mabs 1 through 21, 23 through 222, 224 through 363, and 371 through 405 as provided in Table 2;

with the proviso that the neither the CDRL3, CDRL2, nor the CHRL1 is 100% identical to the CHRL3, CDRL2, or CDRL1, respectively, of any of Mabs 223, 364, 365, 366, 367, 368, 369, or 370 as provided in Table 2.

26. An antibody comprising:

A) a CDRH3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH3 selected from the group consisting of the CDRH3s of Mabs 1 through 21, 23 through 222, 224 through 363, and 371 through 405 as provided in Table 2;

B) a CDRH2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH2 selected from the group consisting of the CDRH2s of Mabs 1 through 21, 23 through 222, 224 through 363, and 371 through 405 as provided in Table 2;

C) a CDRH1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRH1 selected from the group consisting of the CDRH1s of Mabs 1 through 21, 23 through 222, 224 through 363, and 371 through 405 as provided in Table 2;

D) a CDRL3 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL3 selected from the group consisting of the CDRL3s of Mabs 1 through 21, 23 through 222, 224 through 363, and 371 through 405 as provided in Table 2;

E) a CDRL2 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL2 selected from the group consisting of the CDRL2s of Mabs 1 through 21, 23 through 222, 224 through 363, and 371 through 405 as provided in Table 2; and F) a CDRL1 that is: 100% identical to; at least 99% identical to; at least 98% identical to; at least 97% identical to; at least 96% identical to; at least 95% identical to; at least 94% identical to; at least 93% identical to; at least 92% identical to; at least 91% identical to; at least 90% identical to; at least 89% identical to; at least 88% identical to; at least 87% identical to; at least 86% identical to; at least 85% identical to; at least 84% identical to; at least 83% identical to; at least 82% identical to; or at least 80% identical to; a CDRL1 selected from the group consisting of the CDRL1s of Mabs 1 through 21, 23 through 222, 224 through 363, and 371 through 405 as provided in Table 2;

with the proviso that the neither the CDRH3, CDRH2, CDRH1, CDRL3, CDHL2, nor the CHRL1 is 100% identical to the CHRH3, CDRH2, CDRH1, CDRL3, CDHL2, or the CDRL1, respectively, of any of Mabs 223, 364, 365, 366, 367, 368, 369, or 370 as provided in Table 2.

27. An antibody according to any one of Clauses 16 through 26, wherein the antibody comprises an anti-cluster of differentiation three (CD3) binding domain.

28. An antibody according to any one of Clauses 16 through 27, wherein the antibody comprises an anti-cluster of differentiation three (CD3) binding domain that is selected from the group consisting of: the CD3 binding domains of ADI-15512; ADI-15516; and ADI-16513; as provided in Table 2.

29. An antibody according to any one of Clauses 16 through 27, wherein the antibody comprises an anti-cluster of differentiation three (CD3) binding domain that is selected from the group consisting of: the CD3 binding domains of ADI-18562; ADI-18564; ADI-18565; ADI-18566; ADI-18567; ADI-18568; ADI-18570; ADI-18571; ADI-18572; ADI-18573; ADI-18563; ADI-18569; ADI-18574; ADI-18575; ADI-18576; ADI-18578; ADI-18579; ADI-18580; ADI-18581; ADI-18582; ADI-18584; ADI-18585; ADI-18577; ADI-18583; ADI-18588; ADI-18589; ADI-18590; ADI-18591; ADI-18593; ADI-18594; ADI-18595; ADI-18596; ADI-18597; ADI-18592; ADI-18587; ADI-18586; and; ADI-16606; as provided in Table 2.

30. An antibody according to any one of Clauses 16 through 27, wherein the antibody comprises an anti-cluster of differentiation three (CD3) binding domain that is selected from the group consisting of: the CD3 binding domains of ADI-18576; ADI-20820; ADI-20578; ADI-20571; ADI-21097; ADI-20577; ADI-20576; ADI-20568; ADI-20582; ADI-20575; ADI-20567; ADI-20574; ADI-20573; ADI-20579; ADI-18565; ADI-20818; ADI-20587; ADI-20588; ADI-20589; ADI-20590; ADI-20594; ADI- 20596; ADI-20599; ADI-20605; ADI-20607; ADI-20608; and ADI-20609; as provided in Table 2.

31. An antibody according to any one of Clauses 16 through 27, wherein the antibody comprises an anti-cluster of differentiation three (CD3) binding domain that is selected from the group consisting of: the CD3 binding domains of ADI-16606; ADI-20587; ADI-20607; ADI-20590; ADI-28708; ADI-28709; ADI-28710; ADI-21943; ADI-28711; ADI-28712; ADI-28713; ADI-28714; ADI-28715; ADI-21944; ADI-28716; ADI-21945; ADI-21946; ADI-28717; ADI-21947; ADI-28718; ADI-28719; ADI-28720; ADI-28721; ADI-28722; ADI-28723; ADI-28724; ADI-28725; ADI-28726; ADI-28727; ADI-28728; ADI-28729; ADI-28730; ADI-28731; ADI-28732; ADI-28733; ADI-28734; ADI-28735; ADI-28736; ADI-28737; ADI-28738; ADI-28739; ADI-28740; ADI-28741; ADI-28742; ADI-28743; ADI-21948; ADI-21949; ADI-28744; ADI-21950; ADI-28745; ADI-28746; ADI-28747; ADI-28748; ADI-21951; ADI-21952; ADI-28749; ADI-28750; ADI-28751; ADI-21953; ADI-28752; ADI-21954; ADI-28753; ADI-28754; ADI-28755; ADI-28756; ADI-28757; ADI-28758; ADI-28759; ADI-28760; ADI-28761; ADI-28762; ADI-28763; ADI-28764; ADI-28765; ADI-28766; ADI-28767; ADI-28768; ADI-21955; ADI-28769; ADI-28770; ADI-21956; ADI-28771; ADI-28772; ADI-28773; ADI-28774; and ADI-28775; as provided in Table 2.

32. An antibody according to any one of Clauses 16 through 27, wherein the antibody comprises an anti-cluster of differentiation three (CD3) binding domain that is selected from the group consisting of: the CD3 binding domains of ADI-21959; ADI-21963; ADI-21965; ADI-21967; ADI-21970; ADI-21971; ADI-21972; ADI-21973; ADI-21974; ADI-21975; ADI-21976; ADI-21977; ADI-21978; ADI-21979; ADI-21943; ADI-21944; ADI-21945; ADI-21946; ADI-21947; ADI-21948; ADI-21949; ADI-21950; ADI-21951; ADI-21952; ADI-21953; ADI-21954; ADI-21955; and ADI-21956; as provided in Table 2.

33. An antibody according to any one of Clauses 16 through 27, wherein the antibody comprises an anti-cluster of differentiation three (CD3) binding domain that is selected from the group consisting of: the CD3 binding domains of ADI-21952; ADI-22523; ADI-24403; ADI-24404; ADI-24405; ADI-24407; ADI-24408; ADI-24409; ADI-24410; ADI-24411; ADI-24412; ADI-24413; ADI-24414; ADI-24415; ADI-24416; ADI-24417; ADI-24418; ADI-24434; ADI-24435; ADI-24436; ADI-24437; ADI-24438; ADI-24439; ADI-24440; ADI-24441; ADI-24442; ADI-24443; ADI-24444; ADI-24445; ADI-24446; ADI-24449; ADI-24388; ADI-24389; ADI-24390; ADI-24391; ADI-24392; ADI-24393; ADI-24394; ADI-24395; ADI-24396; ADI-24397; ADI-24398; ADI-24399; ADI-24400; ADI-24401; ADI-24402; ADI-24419; ADI-24420; ADI-24421; ADI-24422; ADI-24423; ADI-24424; ADI-24425; ADI-24426; ADI-24427; ADI-24428; ADI-24429; ADI-24430; ADI-24431; ADI-24432; ADI-24433; ADI-24447; and ADI-24448; as provided in Table 2.

34. An antibody according to any one of Clauses 16 through 27, wherein the antibody comprises an anti-cluster of differentiation three (CD3) binding domain that is selected from the group consisting of: the CD3 binding domains of ADI-22523; ADI-23652; ADI-23653; ADI-23654; ADI-23655; ADI-23656; ADI-23657; ADI-23658; ADI-23651; ADI-23644; ADI-23645; ADI-23646; ADI-23647; ADI-23648; ADI-23649; ADI-23650; ADI-23667; ADI-23668; ADI-23669; ADI-23670; ADI-23671; ADI-23672; ADI-23673; ADI-23659; ADI-23660; ADI-23661; ADI-23663; ADI-23664; ADI-23639; ADI-23641; ADI-23642; ADI-23640; ADI-23643; ADI-21952; ADI-23633; ADI-23634; ADI-23635; ADI-23636; ADI-23637; ADI-23638; ADI-23632; and ADI-23629; as provided in Table 2.

35. An antibody according to any one of Clauses 16 through 27, wherein the antibody comprises an anti-cluster of differentiation three (CD3) binding domain that is selected from the group consisting of: the CD3 binding domains of ADI-22523; ADI-26906; ADI-26907; ADI-26908; ADI-26909; ADI-26910; ADI-26912; ADI-26913; ADI-26915; ADI-26916; ADI-26917; ADI-26918; ADI-26919; ADI-26920; ADI-26921; ADI-26924; ADI-26925; ADI-26927; ADI-26928; ADI-26929; ADI-26930; ADI-26932; ADI-26933; ADI-26938; ADI-26939; ADI-26940; ADI-26941; ADI-26942; ADI-26943; ADI-26944; ADI-26945; ADI-26950; ADI-26954; ADI-23672; ADI-23673; ADI-23664; ADI-26955; ADI-26956; ADI-26957; ADI-26958; ADI-26959; ADI-26960; ADI-26962; ADI-26963; ADI-26964; ADI-26965; ADI-26966; ADI-26968; ADI-26969; ADI-26971; ADI-26972; ADI-26973; ADI-26974; ADI-26975; ADI-26976; ADI-26977; ADI-26978; ADI-26979; ADI-26980; ADI-26981; ADI-26982; ADI-26983; ADI-26984; ADI-26985; ADI-26986; ADI-26987; ADI-26988; ADI-26989; ADI-26990; ADI-26991; ADI-26992; ADI-26993; ADI-26994; and ADI-26995; as provided in Table 2.

36. An antibody according to any one of Clauses 16 through 27, wherein the antibody comprises an anti-cluster of differentiation three (CD3) binding domain that is selected from the group consisting of: the CD3 binding domains of ADI-22523; ADI-26906; ADI-26907; ADI-26908; ADI-26910; ADI-26913; ADI-26915; ADI-26919; ADI-26920; ADI-26921; 0J ADI-26943; ADI-26954; ADI-21952; ADI-26955; ADI-26956; ADI-26962; ADI-26978; ADI-26983; and ADI-26994; as provided in Table 2.

37. An antibody according to any one of Clauses 16 through 27, wherein the antibody comprises an anti-cluster of differentiation three (CD3) binding domain that is selected from the group consisting of: ADI-15512; ADI-16513; ADI-15516; ADI-18565; ADI-18589; ADI-18585; ADI-18590; ADI-18576; ADI-20568; ADI-20580; ADI-21978; ADI-22523; ADI-25133; and ADI-26906.

38. An antibody according to any one of Clauses 16 through 27, wherein the antibody comprises an anti-cluster of differentiation three (CD3) binding domain that is selected from the group consisting of: ADI-16606; ADI-29601; ADI-29602; ADI-29603; ADI-20587; ADI-20607; ADI-20590; ADI-21952; ADI-23633; ADI-26955; ADI-26956; ADI-26957; ADI-26958; ADI-26959; ADI-26960; ADI-26961; ADI-26962; ADI-26963; ADI-26964; ADI-26965; ADI-26966; ADI-26967; ADI-26968; ADI-26969; ADI-26970; ADI-26971; ADI-26972; ADI-26973; ADI-26974; ADI-26975; ADI-26976; ADI-26977; ADI-26978; ADI-26979; ADI-26980; ADI-26981; ADI-26982; ADI-26983; ADI-26984; ADI-26985; ADI-26986; ADI-26987; ADI-26988; ADI-26989; ADI-26990; ADI-26991; ADI-26992; ADI-26993; and ADI-26994.

39. An antibody comprising an anti-cluster of differentiation three (CD3) binding domain, wherein said CD3 binding domain is selected from the group consisting of: the CD3 binding domains of ADI-15512; ADI-15516; and ADI-16513; as provided in Table 2.

40. An antibody comprising an anti-cluster of differentiation three (CD3) binding domain, wherein said CD3 binding domain is selected from the group consisting of: the CD3 binding domains of ADI-18562; ADI-18564; ADI-18565; ADI-18566; ADI-18567; ADI-18568; ADI-18570; ADI-18571; ADI-18572; ADI-18573; ADI-18563; ADI- 18569; ADI-18574; ADI-18575; ADI-18576; ADI-18578; ADI-18579; ADI-18580; ADI-18581; ADI-18582; ADI-18584; ADI-18585; ADI-18577; ADI-18583; ADI-18588; ADI-18589; ADI-18590; ADI-18591; ADI-18593; ADI-18594; ADI-18595; ADI-18596; ADI-18597; ADI-18592; ADI-18587; ADI-18586; and; ADI-16606; as provided in Table 2.

41. An antibody comprising an anti-cluster of differentiation three (CD3) binding domain, wherein said CD3 binding domain is selected from the group consisting of: the CD3 binding domains of ADI-18576; ADI-20820; ADI-20578; ADI-20571; ADI-21097; ADI-20577; ADI-20576; ADI-20568; ADI-20582; ADI-20575; ADI-20567; ADI-20574; ADI-20573; ADI-20579; ADI-18565; ADI-20818; ADI-20587; ADI-20588; ADI-20589; ADI-20590; ADI-20594; ADI-20596; ADI-20599; ADI-20605; ADI-20607; ADI-20608; and ADI-20609; as provided in Table 2.

42. An antibody comprising an anti-cluster of differentiation three (CD3) binding domain, wherein said CD3 binding domain is selected from the group consisting of: the CD3 binding domains of ADI-16606; ADI-20587; ADI-20607; ADI-20590; ADI-28708; ADI-28709; ADI-28710; ADI-21943; ADI-28711; ADI-28712; ADI-28713; ADI-28714; ADI-28715; ADI-21944; ADI-28716; ADI-21945; ADI-21946; ADI-28717; ADI-21947; ADI-28718; ADI-28719; ADI-28720; ADI-28721; ADI-28722; ADI-28723; ADI-28724; ADI-28725; ADI-28726; ADI-28727; ADI-28728; ADI-28729; ADI-28730; ADI-28731; ADI-28732; ADI-28733; ADI-28734; ADI-28735; ADI-28736; ADI-28737; ADI-28738; ADI-28739; ADI-28740; ADI-28741; ADI-28742; ADI-28743; ADI-21948; ADI-21949; ADI-28744; ADI-21950; ADI-28745; ADI-28746; ADI-28747; ADI-28748; ADI-21951; ADI-21952; ADI-28749; ADI-28750; ADI-28751; ADI-21953; ADI-28752; ADI-21954; ADI-28753; ADI-28754; ADI-28755; ADI-28756; ADI-28757; ADI-28758; ADI-28759; ADI-28760; ADI-28761; ADI-28762; ADI-28763; ADI-28764; ADI-28765; ADI-28766; ADI-28767; ADI-28768; ADI-21955; ADI-28769; ADI-28770; ADI-28771; ADI-28772; ADI-28773; ADI-28774; and ADI-28775; as provided in Table 2.

43. An antibody comprising an anti-cluster of differentiation three (CD3) binding domain, wherein said CD3 binding domain is selected from the group consisting of: the CD3 binding domains of ADI-21959; ADI-21963; ADI-21965; ADI-21967; ADI-21970; ADI-21971; ADI-21972; ADI-21973; ADI-21974; ADI-21975; ADI-21976; ADI-21977; ADI-21978; ADI-21979; ADI-21943; ADI-21944; ADI-21945; ADI-21946; ADI-21947; ADI-21948; ADI-21949; ADI-21950; ADI-21951; ADI-21952; ADI-21953; ADI-21954; ADI-21955; and ADI-21956; as provided in Table 2.

44. An antibody comprising an anti-cluster of differentiation three (CD3) binding domain, wherein said CD3 binding domain is selected from the group consisting of: the CD3 binding domains of ADI-21952; ADI-22523; ADI-24403; ADI-24404; ADI-24405; ADI-24407; ADI-24408; ADI-24409; ADI-24410; ADI-24411; ADI-24412; ADI-24413; ADI-24414; ADI-24415; ADI-24416; ADI-24417; ADI-24418; ADI-24434; ADI-24435; ADI-24436; ADI-24437; ADI-24438; ADI-24439; ADI-24440; ADI-24441; ADI-24442; ADI-24443; ADI-24444; ADI-24445; ADI-24446; ADI-24449; ADI-24388; ADI-24389; ADI-24390; ADI-24391; ADI-24392; ADI-24393; ADI-24394; ADI-24395; ADI-24396; ADI-24397; ADI-24398; ADI-24399; ADI-24400; ADI-24401; ADI-24402; ADI-24419; ADI-24420; ADI-24421; ADI-24422; ADI-24423; ADI-24424; ADI-24425; ADI-24426; ADI-24427; ADI-24428; ADI-24429; ADI-24430; ADI-24431; ADI-24432; ADI-24433; ADI-24447; and ADI-24448; as provided in Table 2.

45. An antibody comprising an anti-cluster of differentiation three (CD3) binding domain, wherein said CD3 binding domain is selected from the group consisting of: the CD3 binding domains of ADI-22523; ADI-23652; ADI-23653; ADI-23654; ADI-23655; ADI-23656; ADI-23657; ADI-23658; ADI-23651; ADI-23644; ADI-23645; ADI-23646; ADI-23647; ADI-23648; ADI-23649; ADI-23650; ADI-23667; ADI-23668; ADI-23669; ADI-23670; ADI-23671; ADI-23672; ADI-23673; ADI-23659; ADI-23660; ADI-23661; ADI-23663; ADI-23664; ADI-23639; ADI-23641; ADI-23642; ADI-23640; ADI-23643; ADI-21952; ADI-23633; ADI-23634; ADI-23635; ADI-23636; ADI-23637; ADI-23638; ADI-23632; and ADI-23629; as provided in Table 2.

46. An antibody comprising an anti-cluster of differentiation three (CD3) binding domain, wherein said CD3 binding domain is selected from the group consisting of: the CD3 binding domains of ADI-22523; ADI-26906; ADI-26907; ADI-26908; ADI-26909; ADI-26910; ADI-26912; ADI-26913; ADI-26915; ADI-26916; ADI-26917; ADI-26918; ADI-26919; ADI-26920; ADI-26921; ADI-26924; ADI-26925; ADI-26927; ADI-26928; ADI-26929; ADI-26930; ADI-26932; ADI-26933; ADI-26938; ADI-26939; ADI-26940; ADI-26941; ADI-26942; ADI-26943; ADI-26944; ADI-26945; ADI-26950; ADI-26954; ADI-23672; ADI-23673; ADI-23664; ADI-26955; ADI-26956; ADI-26957; ADI-26958; ADI-26959; ADI-26960; ADI-26962; ADI-26963; ADI-26964; ADI-26965; ADI-26966; ADI-26968; ADI-26969; ADI-26971; ADI-26972; ADI-26973; ADI-26974; ADI-26975; ADI-26976; ADI-26977; ADI-26978; ADI-26979; ADI-26980; ADI-26981; ADI-26982; ADI-26983; ADI-26984; ADI-26985; ADI-26986; ADI-26987; ADI-26988; ADI-26989; ADI-26990; ADI-26991; ADI-26992; ADI-26993; ADI-26994; and ADI-26995; as provided in Table 2.

47. An antibody comprising an anti-cluster of differentiation three (CD3) binding domain, wherein said CD3 binding domain is selected from the group consisting of: the CD3 binding domains of ADI-22523; ADI-26906; ADI-26907; ADI-26908; ADI-26910; ADI-26913; ADI-26915; ADI-26919; ADI-26920; ADI-26921; ADI-26943; ADI-26954; ADI-21952; ADI-26955; ADI-26956; ADI-26962; ADI-26978; ADI-26983; and ADI-26994; as provided in Table 2.

48. An antibody comprising an anti-cluster of differentiation three (CD3) binding domain, wherein said CD3 binding domain is selected from the group consisting of: ADI-15512; ADI-16513; ADI-15516; ADI-18565; ADI-18589; ADI-18585; ADI-18590; ADI-18576; ADI-20568; ADI-20580; ADI-21978; ADI-22523; ADI-25133; and ADI-26906.

49. An antibody comprising an anti-cluster of differentiation three (CD3) binding domain, wherein said CD3 binding domain is selected from the group consisting of: ADI-16606; ADI-29601; ADI-29602; ADI-29603; ADI-20587; ADI-20607; ADI-20590; ADI-21952; ADI-23633; ADI-26955; ADI-26956; ADI-26957; ADI-26958; ADI-26959; ADI-26960; ADI-26961; ADI-26962; ADI-26963; ADI-26964; ADI-26965; ADI-26966; ADI-26967; ADI-26968; ADI-26969; ADI-26970; ADI-26971; ADI-26972; ADI-26973; ADI-26974; ADI-26975; ADI-26976; ADI-26977; ADI-26978; ADI-26979; ADI-26980; ADI-26981; ADI-26982; ADI-26983; ADI-26984; ADI-26985; ADI-26986; ADI-26987; ADI-26988; ADI-26989; ADI-26990; ADI-26991; ADI-26992; ADI-26993; and ADI-26994.

50. An antibody according to any one of Clauses 1 through 49, wherein the antibody displays a decreased propensity for degradation relative to one or more of: trastuzumab; (Herceptin®); lintuzumab; blinatumomab (Blincyto®); and Mab 364, Mab366, Mab 367, Mab 368, Mab 369, Mab 370, or Mab 22, as provided in Table 2.

51. An antibody according to any one of Clauses 16 through 49, wherein the antibody displays a decreased CRS risk profile relative to one or more of: trastuzumab; (Herceptin®); lintuzumab; blinatumomab (Blincyto®); and Mab 364, Mab366, Mab 367, Mab 368, Mab 369, Mab 370, or Mab 22, as provided in Table 2.

52. An antibody according to any one of Clauses 1 through 51, wherein the antibody comprises a multispecific antibody.

53. An antibody according to any one of Clauses 1 through 52, wherein the antibody comprises a bispecific antibody.

54. An antibody according to any one of Clauses 1 through 53, wherein the antibody comprises at least a second antigen binding domain that specifically binds to an oncology target; an immune-oncology target; a neurodegenerative disease targets; an autoimmune disorder target; an infectious disease target; a metabolic disease target; a cognitive disorder target; a blood-brain barrier target; or a blood disease target.

55. An antibody according to any one of Clauses 1 through 54, wherein the antibody comprises at least a second antigen binding domain that specifically binds to an antigen selected from the group consisting of: 17-IA, 4-1BB, 4Dc, 6-keto-PGF1a, 8-iso-PGF2a, 8-oxo-dG, A1 Adenosine Receptor, A33, ACE, ACE-2, Activin, Activin A, Activin AB, Activin B, Activin C, Activin RIA, Activin RIA ALK-2, Activin RIB ALK-4, Activin RIIA, Activin RUB, ADAM, ADAM10, ADAM12, ADAM15, ADAM17/TACE, ADAM8, ADAM9, ADAMTS, ADAMTS4, ADAMTS5, Addressins, aFGF, ALCAM, ALK, ALK-1, ALK-7, alpha-1-antitrypsin, alpha-V/beta-1 antagonist, ANG, Ang, APAF-1, APE, APJ, APP, APRIL, AR, ARC, ART, Artemin, anti-Id, ASPARTIC, Atrial natriuretic factor, av/b3 integrin, Axl, b2M, B7-1, B7-2, B7-H, B-lymphocyte Stimulator (BlyS), BACE, BACE-1, Bad, BAFF, BAFF-R, Bag-1, BAK, Bax, BCA-1, BCAM, Bel, BCMA, BDNF, b-ECGF, bFGF, BID, Bik, BIM, BLC, B-CAM, BLK, BMP, BMP-2 BMP-2a, BMP-3 Osteogenin, BMP-4 BMP-2b, BMP-5, BMP-6 Vgr-1, BMP-7 (OP-1), BMP-8 (BMP-8a, OP-2), BMPR, BMPR-IA (ALK-3), BMPR-IB (ALK-6), BRK-2, RPK-1, BMPR-II (BRK-3), BMPs, b-NGF, BOK, Bombesin, Bone-derived neurotrophic factor, BPDE, BPDE-DNA, BTC, complement factor 3 (C3), C3a, C4, C5, C5a, CIO, CA125, CAD-8, Calcitonin, cAMP, carcinoembryonic antigen (CEA), carcinoma-associated antigen, Cathepsin A, Cathepsin B, Cathepsin C/DPPI, Cathepsin D, Cathepsin E, Cathepsin H, Cathepsin L, Cathepsin O, Cathepsin S, Cathepsin V, Cathepsin X/Z/P, CBL, CCI, CCK2, CCL, CCL1, CCL11, CCL12, CCL13, CCL 14, CCL15, CCL16, CCL1 7, CCL18, CCL19, CCL2, CCL20, CCL21, CCL22, CCL23, CCL24, CCL25, CCL26, CCL27, CCL28, CCL3, CCL4, CCL5, CCL6, CCL7, CCL8, CCL9/10, CCR, CCR1, CCR10, CCR10, CCR2, CCR3, CCR4, CCR5, CCR6, CCR7, CCR8, CCR9, CD1, CD2, CD4, CD5, CD6, CD7, CD8, CD10, CD11a, CD11b, CD11c, CD13, CD14, CD15, CD16, CD18, CD19, CD20, CD21, CD22, CD23, CD25, CD27L, CD28, CD29, CD30, CD30L, CD32, CD33 (p67 proteins), CD34, CD38, CD40, CD40L, CD44, CD45, CD46, CD49a, CD52, CD54, CD55, CD56, CD61, CD64, CD66e, CD74, CD80 (B7-1), CD89, CD95, CD123, CD137, CD138, CD140a, CD146, CD147, CD148, CD152, CD164, CEACAM5, CFTR, cGMP, CINC, *Clostridium botulinum* toxin, *Clostridium perfringens* toxin, CKb8-1, CLC, CMV, CMV UL, CNTF, CNTN-1, COX, C-Ret, CRG-2, CT-1, CTACK, CTGF, CTLA-4, CX3CL1, CX3CR1, CXCL, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCR, CXCR1, CXCR2, CXCR3, CXCR4, CXCR5, CXCR6, cytokeratin tumor-associated antigen, DAN, DCC, DcR3, DC-SIGN, Decay accelerating factor, des(1-3)-IGF-I (brain IGF-1), Dhh, digoxin, DNAM-1, Dnase, Dpp, DPPIV/CD26, Dtk, ECAD, EDA, EDA-A1, EDA-A2, EDAR, EGF, EGFR (ErbB-1), EMA, EMMPRIN, EN A, endothelin receptor, Enkephalinase, eNOS, Eot, eotaxin1, EpCAM, Ephrin B2/EphB4, EPO, ERCC, E-selectin, ET-1, Factor IIa, Factor VII, Factor VIIIc, Factor IX, fibroblast activation protein (FAP), Fas, FcR1, FEN-1, Ferritin, FGF, FGF-19, FGF-2, FGF3, FGF-8, FGFR, FGFR-3, Fibrin, FL, FLIP, Flt-3, Flt-4, Follicle stimulating hormone, Fractalkine, FZD1, FZD2, FZD3, FZD4, FZD5, FZD6, FZD7, FZD8, FZD9, FZD10, G250, Gas 6, GCP-2, GCSF, GD2, GD3, GDF, GDF-1, GDF-3 (Vgr-2), GDF-5 (BMP-14, CDMP-1), GDF-6 (BMP-13, CDMP-2), GDF-7 (BMP-12, CDMP-3), GDF-8 (Myostatin), GDF-9, GDF-15 (MIC-1), GDNF, GFAP, GFRa-1, GFR-alpha1, GFR-alpha2, GFR-alpha3, GITR, Glucagon, Glut 4, glycoprotein IIb/IIIa (GP IIb/IIIa), GM-CSF, gp130, gp72, GRO, Growth hormone releasing factor, Hapten (NP-cap or NIP-cap), HB-EGF, HCC, HCMV gB envelope glycoprotein, HCMV) gH envelope glycoprotein, HCMV UL, Hemopoietic growth factor (HGF), Hep B gpl20, heparanase, Her2, Her2/neu (ErbB-2), Her3 (ErbB-3), Her4 (ErbB-4), herpes simplex virus (HSV) gB glycoprotein, HSV gD glycoprotein, HGFA, High molecular weight melanoma-associated antigen (HMW-MAA), HIV gpl20, HIV IIIB gp 120 V3 loop, HLA, HLA-DR, HM1.24, HMFG PEM, HRG, Hrk, human cardiac myosin, human cytomegalovirus (HCMV), human growth hormone (HGH), HVEM, 1-309, IAP, ICAM, ICAM-1, ICAM-3, ICE, ICOS, IFNg, Ig, IgA receptor, IgE, IGF, IGF binding proteins, IGF-1R, IGFBP, IGF-I, IGF-II, IL, IL-1, IL-1R, IL-2, IL-2R, IL-4, IL-4R, IL-5, IL-5R, IL-6, IL-6R, IL-8, IL-9, IL-10, IL-12, IL-13, IL-15, IL-18, IL-18R, IL-23, interferon (INF)-alpha, INF-beta, INF-gamma, Inhibin, iNOS, Insulin A-chain, Insulin B-chain, Insulin-like growth factor 1, integrin alpha2, integrin alpha3, integrin alpha4, integrin alpha4/beta1, integrin, alpha4/beta7, integrin alpha5 (alphaV), integrin alpha5/beta1, integrin alpha5/beta3, integrin alpha6, integrin beta1, integrin beta2, interferon gamma, IP-10, 1-TAC, JE, Kallikrein 2, Kallikrein 5, Kallikrein 6, Kallikrein 11, Kallikrein 12, Kallikrein 14, Kallikrein 15, Kallikrein LI, Kallikrein L2, Kallikrein L3, Kallikrein L4, KC, KDR, Keratinocyte Growth Factor (KGF), laminin 5, LAMP, LAP, LAP (TGF-1), Latent TGF-1, Latent TGF-1 bpl, LBP, LDGF, LECT2, Lefty, Lewis-Y antigen, Lewis-Y related antigen, LFA-1, LFA-3, Lfo, LIF, LIGHT, lipoproteins, LIX, LKN, Lptn, L-Selectin, LT-a, LT-b, LTB4, LTBP-1, Lung surfactant, Luteinizing hormone, Lymphotoxin Beta Receptor, Mac-1, MAdCAM, MAG, MAP2, MARC, MCAM, MCAM, MCK-2, MCP, M-CSF, MDC, Mer, METALLOPROTEASES, MGDF receptor, MGMT, MHC (HLA-DR), MIF, MIG, MIP, MIP-1-alpha, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, MPIF, Mpo, MSK, MSP, mucin (Mucl), MUC18, Muellerian-inhibiting substance, Mug, MuSK, NAIP, NAP, NCAD, N-Cadherin, NCA 90, NCAM, NCAM, Neprilysin, Neurotrophin-3, -4, or -6, Neurturin, Neuronal growth factor (NGF), NGFR, NGF-beta, nNOS, NO, NOS, Npn, NRG-3, NT, NTN, OB, OGG1, OPG, OPN, OSM, OX40L, OX40R, p150, p95, PADPr, Parathyroid hormone, PARC, PARP, PBR, PBSF, PCAD, P-Cadherin, PCNA, PDGF, PDGF, PDK-1, PECAM, PEM, PF4, PGE, PGF, PGI2, PGJ2, PIN, PLA2, placental alkaline phosphatase (PLAP), P1GF, PLP, PP14, Proinsulin, Prorelaxin, Protein C, PS, PSA, PSCA, prostate specific membrane antigen (PSMA), PTEN, PTHrp, Ptk, PTN, R51, RANK, RANKL, RANTES, Relaxin A-chain, Relaxin B-chain, renin, respiratory syncytial virus (RSV) F, RSV Fgp, Ret, Rheumatoid factors, RLIP76, RPA2, RSK, S100, SCF/KL, SDF-1, SERINE, Serum albumin, sFRP-3, Shh, SIGIRR, SK-1, SLAM, SLPI, SMAC, SMDF, SMOH, SOD, SPARC, Stat, STEAP, STEAP-II, TACE, TACI, TAG-72 (tumor-associated glycoprotein-72), TARC, TCA-3, T-cell receptors (e.g., T-cell receptor alpha/beta), TdT, TECK, TEM1, TEM5, TEM7, TEM8, TERT, testicular PLAP-like alkaline phosphatase, TfR, TGF, TGF-alpha, TGF-beta, TGF-beta Pan Specific, TGF-beta RI (ALK-5), TGF-beta RII, TGF-beta Rllb, TGF-beta RIII, TGF-beta1, TGF-beta2, TGF-beta3, TGF-beta4, TGF-beta5, Thrombin, Thymus Ck-1, Thyroid stimulating hormone, Tie, TIMP, TIQ, Tissue Factor, TMEFF2, Tmpo, TMPRSS2, TNF, TNF-alpha, TNF-alpha beta, TNF-beta2, TNFc, TNF-RI, TNF-RII, TNFRSF10A (TRAIL R1 Apo-2, DR4), TNFRSFIOB (TRAIL R2 DR5, KILLER, TRICK-2A, TRICK-B), TNFRSF10C (TRAIL R3 DcR1, LIT, TRID), TNFRSF10D (TRAIL R4 DcR2, TRUNDD), TNFRSF11A (RANK ODF R, TRANCE R), TNFRSF11B (OPG OCIF, TR1), TNFRSF12 (TWEAK R FN14), TNFRSF13B (TACI), TNFRSF13C (BAFF R), TNFRSF14 (HVEM ATAR, HveA, LIGHT R, TR2), TNFRSF16 (NGFR p75NTR), TNFRSF17 (BCMA), TNFRSF18 (GITR AITR), TNFRSF19 (TROY TAJ, TRADE), TNFRSF19L (RELT), TNFRSFIA (TNF RI CD120a, p55-60), TNFRSFIB (TNF RII CD120b, p75-80), TNFRSF26 (TNFRH3), TNFRSF3 (LTbR TNF RIII, TNFC R), TNFRSF4 (OX40 ACT35, TXGP1 R), TNFRSF5 (CD40 p50), TNFRSF6 (Fas Apo-1, APT1, CD95), TNFRSF6B (DcR3 M68, TR6), TNFRSF7 (CD27), TNFRSF8 (CD30), TNFRSF9 (4-1BB CD137, ILA), TNFRSF21 (DR6), TNFRSF22 (DcTRAIL R2 TNFRH2), TNFRST23 (DcTRAIL RI TNFRH1), TNFRSF25 (DR3 Apo-3, LARD, TR-3, TRAMP, WSL-1), TNFSF10 (TRAIL Apo-2 Ligand, TL2), TNFSF11 (TRANCE/RANK Ligand ODF, OPG Ligand), TNFSF12 (TWEAK Apo-3 Ligand, DR3 Ligand), TNFSF13 (APRIL TALL2), TNFSF13B (BAFF BLYS, TALL1, THANK, TNFSF20), TNFSF14 (LIGHT HVEM Ligand, LTg), TNFSF15 (TL1A/VEGI), TNFSF18 (GITR Ligand AITR Ligand, TL6), TNFSFIA (TNF-α Conectin, DIF, TNFSF2), TNFSF1B (TNF-b LTa, TNFSF1), TNFSF3 (LTb TNFC, p33), TNFSF4 (OX40 Ligand gp34, TXGP1), TNFSF5 (CD40 Ligand CD154, gp39, HIGM1, IMD3, TRAP), TNFSF6 (Fas Ligand Apo-1 Ligand, APT1 Ligand), TNFSF7 (CD27 Ligand CD70), TNFSF8 (CD30 Ligand CD153), TNFSF9 (4-1BB Ligand CD137 Ligand), TP-1, t-PA, Tpo, TRAIL, TRAIL R, TRAIL-R1, TRAIL-R2, TRANCE, transferring receptor, TRF, Trk, TROP-2, TSG, TSLP, tumor-associated antigen CA 125, tumor-associated antigen expressing Lewis Y related carbohydrate, TWEAK, TXB2, Ung, uPAR, uPAR-1, Urokinase, VCAM, VCAM-1, VECAD, VE-Cadherin, VE-cadherin-2, VEFGR-1 (fit-1), VEGF, VEGFR, VEGFR-3 (fit-4), VEGI, VIM, Viral antigens, VLA, VLA-1, VLA-4, VNR integrin, von Willebrands factor, WIF-1, WNT1, WNT2, WNT2B/13, WNT3, WNT3A, WNT4, WNT5A, WNT5B, WNT6, WNT7A, WNT7B, WNT8A, WNT8B, WNT9A, WNT9A, WNT9B, WNT10A, WNT10B, WNT11, WNT16, XCL1, XCL2, XCR1, XCR1, XEDAR, XIAP, XPD, CTLA4 (cytotoxic T lymphocyte antigen-4), PD1 (programmed cell death protein 1), PD-L1 (programmed cell death ligand 1), LAG-3 (lymphocyte activation gene-3), TIM-3 (T cell immunoglobulin and mucin protein-3), receptors for hormones, and growth factors.

56. An antibody according to any one of Clauses 1 through 55, wherein the antibody comprises at least a second antigen binding domain that specifically binds to an antigen selected from the group consisting of: BCMA, CTLA4 (cytotoxic T lymphocyte antigen-4), PD1 (programmed cell death protein 1), PD-L1 (programmed cell death ligand 1), LAG-3 (lymphocyte activation gene-3), TIM-3, CD20, CD2, CD19, Her2, EGFR, EpCAM, FcyRIIIa (CD16), FcyRIIa (CD32a), FcyRIIb (CD32b), FcyRI (CD64), Toll-like receptors (TLRs), TLR4, TLR9, cytokines, IL-2, IL-5, IL-13, IL-6, IL-17, IL-12, IL-23, TNFa, TGFb, cytokine receptors, IL-2R, chemokines, chemokine receptors, growth factors, VEGF, and HGF.

57. An antibody according to any one of Clauses 1 through 56, wherein the antibody comprises at least a second antigen binding domain that specifically binds to an antigen, wherein said antibody comprises a multispecific format selected from the group consisting of: Fab-Fc-scFv, "bottle-opener, Mab-scFv, Mab-Fv, Dual scFv, central Fv, central scFv, one-arm central scFv, Fab-Fab, Fab-Fv, mAb-Fv, mAb-Fab, DART, BiTE, common light chain-IgG, TandAb, Cross-Mab, SEED, BEAT, TrioMab, and DuetMab.

58. An isolated nucleic acid sequence encoding an antibody according to any one of Clauses 1 through 57.

59. An expression vector comprising the isolated nucleic acid sequence according to Clause 58.

60. A host cell transfected, transformed, or transduced with a nucleic acid sequence according to Clause 58 or an expression vector according to Clause 59.

61. A pharmaceutical composition comprising: one or more of an antibody according to any one of Clauses 1 through 57; and a pharmaceutically acceptable carrier and/or excipient.

62. A pharmaceutical composition comprising: one or more nucleic acid sequences according to Clause 58; or one or more the expression vectors according to Clause 59; and a pharmaceutically acceptable carrier and/or excipient.

63. A method of treating or delaying the progression of a disorder in a mammal in need of such treating, the method comprising administering one or more antibodies according to any one of Clauses 1 through 57, wherein the disorder is decreased or ameliorated as a result of said administering.

64. A method of preventing or decreasing risk of developing a disorder in a mammal by administering an antibody according any one of Clauses 1 through 57, wherein the disorder is prevented as a result of said administering.

65. A method of treating a disorder in a mammal in need of such treating, wherein the disorder comprises a proliferative disorder, an oncological disorder, an immuno-oncological disorder, a neurological disorder, a neurodegenerative disorder, or an autoimmune disorder, comprising administering one or more antibodies according to any one of Clauses 1 through 57, wherein the disorder is decreased or ameliorated as a result of said administering.

66. The method according to any one of Clauses 63 through 65, wherein the method further comprises administering to the mammal an additional therapeutic agent.

67. The method according to any one of Clauses 63 through 66, wherein the mammal is a human.

68. A heterodimeric CD3 fusion protein comprising: a first polypeptide chain comprising a CD3 epsilon polypeptide fused to a first Fc region; and a second polypeptide chain comprising CD3 delta polypeptide fused to a second Fc region.

69. The heterodimeric CD3 fusion protein according to Clause 68, wherein the CD3 epsilon polypeptide comprises a human CD3 epsilon polypeptide and the CD3 delta polypeptide comprises a human CD3 delta polypeptide.

70. The heterodimeric CD3 fusion protein according to Clause 68, wherein the CD3 epsilon polypeptide is a human CD3 epsilon polypeptide and the CD3 delta polypeptide is a human CD3 delta polypeptide.

71. The heterodimeric CD3 fusion protein according to Clause 69, wherein the CD3 epsilon polypeptide comprises a cynomolgus CD3 epsilon polypeptide and the CD3 delta polypeptide comprises a cyno CD3 delta polypeptide.

72. The heterodimeric CD3 fusion protein according to Clause 69, wherein the CD3 epsilon polypeptide is a cynomolgus CD3 epsilon polypeptide and the CD3 delta polypeptide is a cyno CD3 delta polypeptide.

73. The heterodimeric fusion protein according to any one of Clauses 68 through 70, wherein the first polypeptide

QDGNEEMGGITQTPYKVSISGTTVILTCPQYPGSEILWQHNDKNIGGDED

DKNIGSDEDHLSLKEFSELEQSGYYVCYPRGSKPEDANFYLYLRARVCEN

CMEMDGGSDKTHTCPPCPAPELLGGPSVFLFPPKPKDTLMISRTPEVTCV

VVDVSHEDPEVKFNWYVDGVEVHNAKTKPREEQYASTYRVVSVLTVLHQD

WLNGKEYKCKVSNKALPAPIEKTISKAKGQPREPQVYTLPPSRDELTKNQ

VSLTCLVKGFYPSDIAVEWESNGQPENNYKTTPPVLDSDGSFFLYSKLTV

DKSRWQQGNVFSCSVMHEALHNHYTQKSLSLSPGK;

and the second polypeptide chain comprises the following amino acid sequence:

FKIPIEELEDRVFVNCNTSITWVEGTVGTLLSDITRLDLGKRILDPRGIY

RCNGTDIYKDKESTVQVHYRMCQSCVELDGGSDKTHTCPPCPAPELLGGP

SVFLFPPKPKDTLMISRTPEVTCVVVDVSHEDPEVKFNWYVDGVEVHNAK

TKPREEQYASTYRVVSVLTVLHQDWLNGKEYKCKVSNKALPAPIEKTISK

AKGQPREPQVYTLPPSRDELTKNQVSLTCLVKGFYPSDIAVEWESNGQPE

NNYKTTPPVLDSDGSFFLYSKLTVDKSRWQQGNVFSCSVMHEALHNHYTQ

KSLSLSPGK.

74. The heterodimeric fusion protein according to any one of Clauses 68, 71, and 72, wherein the first polypeptide chain comprises the following amino acid sequence:

QDGNEEMGSITQTPYQVSISGTTVILTCSQHLGSEAQWQHNGKNKEDSGD

RLFLPEFSEMEQSGYYVCYPRGSNPEDASHHLYLKARVCENCMEMDGGSD

KTHTCPPCPAPELLGGPSVFLFPPKPKDTLMISRTPEVTCVVVDVSHEDP

EVKFNWYVDGVEVHNAKTKPREEQYASTYRVVSVLTVLHQDWLNGKEYKC

KVSNKALPAPIEKTISKAKGQPREPQVYTLPPSRDELTKNQVSLTCLVKG

FYPSDIAVEWESNGQPENNYKTTPPVLDSDGSFFLYSKLTVDKSRWQQGN

VFSCSVMHEALHNHYTQKSLSLSPGK;

and the second polypeptide chain comprises the following amino acid sequence:

FKIPVEELEDRVFVKCNTSVTWVEGTVGTLLTNNTRLDLGKRILDPRGIY

RCNGTDIYKDKESAVQVHYRMCQNCVELDPGSDKTHTCPPCPAPELLGGP

SVFLFPPKPKDTLMISRTPEVTCVVVDVSHEDPEVKFNWYVDGVEVHNAK

TKPREEQYASTYRVVSVLTVLHQDWLNGKEYKCKVSNKALPAPIEKTISK

AKGQPREPQVYTLPPSRDELTKNQVSLTCLVKGFYPSDIAVEWESNGQPE

NNYKTTPPVLDSDGSFFLYSKLTVDKSRWQQGNVFSCSVMHEALHNHYTQ

KSLSLSPGK.

75. An antibody or antigen-binding polypeptide comprising a CDRH1 comprising an amino acid sequence of FNIKDYYMH (SEQ ID NO: 6720), YTFTSYTIH (SEQ ID NO: 6721), or FTFX$_1$TYAMN (SEQ ID NO: 6722), wherein X$_1$ is any amino acid.

76. The antibody or antigen-binding polypeptide according to Clause 75, wherein X$_1$ is N or D.

77. An antibody or antigen-binding polypeptide comprising a CDRH2 comprising an amino acid sequence of WIDLENX$_1$NTX$_2$YDX$_3$KFOG (SEQ ID NO: 6723), wherein X$_1$, X$_2$, and X$_3$ independently are any amino acid.

78. The antibody or antigen-binding polypeptide according to Clause 77, wherein X$_1$ is not G.

79. The antibody or antigen binding polypeptide of any of Clauses 77-78, wherein X$_2$ is V or I.

80. The antibody or antigen binding polypeptide of any of Clauses 77-79, wherein X$_3$ is not G.

81. An antibody or antigen-binding polypeptide comprising a CDRH3 comprising an amino acid sequence of X$_1$QSYSX$_2$RT (SEQ ID NO: 6724) or X$_3$RDX$_4$YGX$_5$YFYDV (SEQ ID NO: 6725), wherein X$_1$, X$_2$, X$_3$, X$_4$, and X$_5$ are independently are any amino acid.

82. The antibody or antigen-binding polypeptide of Clause 81, wherein X$_1$ is K or T.

83. The antibody or antigen-binding polypeptide of Clause 81, wherein X$_1$ is T.

84. The antibody or antigen-binding polypeptide of any of Clauses 81-83, wherein X$_2$ is R or L.

85. The antibody or antigen-binding polypeptide of any of Clauses 81-83, wherein X$_3$ is A or G.

86. The antibody or antigen-binding polypeptide of any of Clause 81-83, wherein X$_4$ is not G.

87. The antibody or antigen-binding polypeptide of any of Clauses 81-86, wherein X$_5$ is R, A, G, or L.

88. An antibody or antigen-binding polypeptide comprising a CDRL1 comprising an amino acid sequence of X$_1$KSSQX$_2$LLX$_3$X$_4$RTGKX$_5$YLA (SEQ ID NO: 6726), wherein X$_1$, X$_2$, X$_3$, X$_4$, and X$_5$ independently are any amino acid.

89. The antibody or antigen-binding polypeptide according to Clause 88, wherein X$_1$ is K or R.

90. The antibody or antigen-binding polypeptide according to Clause 88, wherein X$_2$ is S or N 91. The antibody or antigen-binding polypeptide according to Clause 88, wherein X$_3$ is E or N.

92. The antibody or antigen-binding polypeptide according to Clause 88, wherein X$_4$ is A or S.

93. The antibody or antigen-binding polypeptide according to Clause 88, wherein X$_5$ is N or S.

94. An antibody or antigen-binding polypeptide comprising a CDRL2 comprising an amino acid sequence of WASTRES (SEQ ID NO: 6727) or GTX$_1$KRAP (SEQ ID NO: 6728), wherein X$_1$ is any amino acid.

95. The antibody or antigen-binding polypeptide according to Clause 94, wherein X$_1$ is N or D.

96. An antibody or antigen-binding polypeptide comprising a CDRL3 comprising an amino acid sequence of KQSYSX$_1$RT (SEQ ID NO: 6729), wherein X$_1$ is any amino acid.

97. The antibody or antigen-binding polypeptide according to Clause 96, wherein X$_1$ is R.

98. The antibody or antigen binding polypeptide according to Clause 96, wherein X$_1$ is L or I.

99. An antibody or antigen binding polypeptide comprising one or more of a CDRH1 according to any of Clauses 75-76, a CDRH2 according to any of Clauses 77-81, and a CDRH3 according to any of Clauses 84-90.

100. An antibody or antigen-binding polypeptide comprising one or more of a CDRL1 according to any of Clauses 88-91, a CDRL2 according to any of Clauses 94-95, and a CDRL3 according to any of Clauses 96-98.

101. An antibody or antigen-binding polypeptide comprising a CDRH1 according to any of Clauses 75-76, a CDRH2 according to any of Clauses 77-81, a CDRH3 according to any of Clauses 84-90, and a CDRL1 according to any of Clauses 88-91, a CDRL2 according to any of Clauses 94-95, and a CDRL3 according to any of Clauses 96-98.

LENGTHY TABLES

The patent contains a lengthy table section. A copy of the table is available in electronic form from the USPTO web site (https://seqdata.uspto.gov/?pageRequest=docDetail&DocID=US11542330B2). An electronic copy of the table will also be available from the USPTO upon request and payment of the fee set forth in 37 CFR 1.19(b)(3).

SEQUENCE LISTING (7034 sequences)

SEQ ID NO: 1 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttaacacatatgccatgaattgggtccgccaggctccagggaaggggctggagtgggtcgcaaggattagatccaagtataacaattacgctacatactacgcagactccgtgaaggatcggttcaccatctccagagacgattccaagagcacgctgtatctgcaaatgaacagcctgagagccgaggacacggcggtgtactactgcgtcaggcacggtaacttcgggaacagttatgtatcctggtttgcttattggggccaaggaaccctggtcaccgtctcctca

SEQ ID NO: 2 - protein, 125 aa, Artificial Sequence
  Description of Artificial Sequence: Synthetic Heavy chain variable region amino acid sequence
EVQLLESGGGLVQPGGSLRLSCAASGFTFNTYAMNWVRQAPGKGLEWVARIRSKYNNYATYYADSVKDRFTISRDDSKSTLYLQMNSLRAEDTAVYYCVRHGNFGNSYVSWFAYWGQGTLVTVSS

SEQ ID NO: 3 - protein, 9 aa, Artificial Sequence
  Description of Artificial Sequence: Synthetic Heavy chain variable region CDR H1 amino acid sequence
FTFNTYAMN

SEQ ID NO: 4 - DNA, 27 bp, Artificial Sequence
  Description of Artificial Sequence: Synthetic Heavy chain variable region CDR H1 nucleic acid sequence
ttcacctttaacacatatgccatgaat

SEQ ID NO: 5 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6 - DNA, 57 bp, Artificial Sequence
  Description of Artificial Sequence: Synthetic Heavy chain variable region CDR H2 nucleic acid sequence
aggattagatccaagtataacaattacgctacatactacgcagactccgtgaaggat

SEQ ID NO: 7 - protein, 16 aa, Artificial Sequence
  Description of Artificial Sequence: Synthetic Heavy chain variable region CDR H3 amino acid sequence
VRHGNFGNSYVSWFAY

SEQ ID NO: 8 - DNA, 48 bp, Artificial Sequence
  Description of Artificial Sequence: Synthetic Heavy chain variable region CDR H3 nucleic acid sequence
gtcaggcacggtaacttcgggaacagttatgtatcctggtttgcttat

SEQ ID NO: 9 - DNA, 327 bp, Artificial Sequence
  Description of Artificial Sequence: Synthetic Light chain variable region nucleic acid sequence
cagactgtggtgacccaggagccatcgttctcagtgtcccctggagggacagtcacactcacttgtagatcaagcactggcgcagtcactactagtaactacgccaactgggtccagcagaccccaggccaggctccacgcggactcatcggcggcacaaacaagcgcgctcctggggtccctgatcgcttctctggctccctgcttggggacaaagctgccctcaccatcacgggggcccaggcagatgatgaatctgattattactgtgcgctgtggtacagtaacctttgggtgttcggcggagggaccaagctgaccgtccta

SEQ ID NO: 10 - protein, 109 aa, Artificial Sequence
  Description of Artificial Sequence: Synthetic Light chain variable region amino acid sequence
QTVVTQEPSFSVSPGGTVTLTCRSSTGAVTTSNYANWVQQTPGQAPRGLIGGTNKRAPGVPDRFSGSLLGDKAALTITGAQADDESDYYCALWYSNLWVFGGGTKLTVL

SEQ ID NO: 11 - protein, 14 aa, Artificial Sequence
  Description of Artificial Sequence: Synthetic Light chain variable region CDR L1 amino acid sequence
RSSTGAVTTSNYAN

SEQ ID NO: 12 - DNA, 42 bp, Artificial Sequence
  Description of Artificial Sequence: Synthetic Light chain variable region CDR L1 nucleic acid sequence
agatcaagcactggcgcagtcactactagtaactacgccaac

SEQ ID NO: 13 - protein, 7 aa, Artificial Sequence
  Description of Artificial Sequence: Synthetic Light chain variable region CDR L2 amino acid sequence
GTNKRAP

SEQ ID NO: 14 - DNA, 21 bp, Artificial Sequence
  Description of Artificial Sequence: Synthetic Light chain variable region CDR L2 nucleic acid sequence
ggcacaaacaagcgcgctcct

SEQ ID NO: 15 - protein, 9 aa, Artificial Sequence
  Description of Artificial Sequence: Synthetic Light chain variable region CDR L3 amino acid sequence
ALWYSNLWV

SEQ ID NO: 16 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 17 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatgaacagcctgagagccgaggacacggcggtgtactactgcgtcaggcacggtaacttcgggaacggttacgtatcctggtttgctcattggggccaaggaaccctggtcaccgtctcctca

SEQ ID NO: 18 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMNSLRAEDTAVYYCVRHGNFGNGYVSWFAHWGQGTLVTVSS

SEQ ID NO: 19 - protein, 9 aa, Artificial Sequence
  Description of Artificial Sequence: Synthetic Heavy chain variable region CDR H1 amino acid sequence
FTFDTYAMN

SEQ ID NO: 20 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 21 - protein, 19 aa, Artificial Sequence
  Description of Artificial Sequence: Synthetic Heavy chain variable region CDR H2 amino acid sequence
RIRSKYNNYATYYADSVKD

SEQ ID NO: 22 - DNA, 57 bp, Artificial Sequence; identical to SEQ ID NO: 6
  Description of Artificial Sequence: Synthetic Heavy chain variable region CDR H2 nucleic acid sequence

SEQ ID NO: 23 - protein, 16 aa, Artificial Sequence
  Description of Artificial Sequence: Synthetic Heavy chain variable region CDR H3 amino acid sequence
VRHGNFGNGYVSWFAH

SEQ ID NO: 24 - DNA, 48 bp, Artificial Sequence
  Description of Artificial Sequence: Synthetic Heavy chain variable region CDR H3 nucleic acid sequence
gtcaggcacggtaacttcgggaacggttacgtatcctggtttgctcat

SEQ ID NO: 25 - DNA, 327 bp, Artificial Sequence
  Description of Artificial Sequence: Synthetic Light chain variable region nucleic acid sequence
cagactgtggtgacccaggagccatcgctctcggtgtcccctggagggacagtcacactcacttgtagatcaagcactggcgcagtcactactagtaactacgccaactgggtccagcagaccccaggccaggctccgcgcggactcatcggcggcacagacaagcgcgctcccggggtccctgatcgcttctctggctccctgcttggggacaaagctgccctcaccatcacgggggcccaggcagaggatgaatctgattattactgtgcgctgtggtacagtaacctttgggtgttcggcggagggaccaagctgaccgtccta

SEQ ID NO: 26 - protein, 109 aa, Artificial Sequence
  Description of Artificial Sequence: Synthetic Light chain variable region amino acid sequence
QTVVTQEPSLSVSPGGTVTLTCRSSTGAVTTSNYANWVQQTPGQAPRGLIGGTDKRAPGVPDRFSGSLLGDKAALTITGAQAEDESDYYCALWYSNLWVFGGGTKLTVL

SEQ ID NO: 27 - protein, 14 aa, Artificial Sequence
  Description of Artificial Sequence: Synthetic Light chain variable region CDR L1 amino acid sequence
RSSTGAVTTSNYAN

SEQ ID NO: 28 - DNA, 42 bp, Artificial Sequence; identical to SEQ ID NO: 12
  Description of Artificial Sequence: Synthetic Light chain variable region CDR L1 nucleic acid sequence

SEQ ID NO: 29 - protein, 7 aa, Artificial Sequence
  Description of Artificial Sequence: Synthetic Light chain variable region CDR L2 amino acid sequence
GTDKRAP

SEQ ID NO: 30 - DNA, 21 bp, Artificial Sequence
  Description of Artificial Sequence: Synthetic Light chain variable region CDR L2 nucleic acid sequence
ggcacagacaagcgcgctccc

SEQ ID NO: 31 - protein, 9 aa, Artificial Sequence
  Description of Artificial Sequence: Synthetic Light chain variable region CDR L3 amino acid sequence
ALWYSNLWV

SEQ ID NO: 32 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 33 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggtccgccaggctccagggaaggggctggagtgggtcgcaaggattagatccaagtataacaattacgctacatactacgcagactccgtgaaggatcggttcaccatctccagagacgattccaagagcacgctgtatctgcaaatgaacagcctgagagccgaggacacggcggtgtactactgcgtcaggcacggtaacttcgggaacggttacgtatcctggtttgctcattggggccaaggaaccctggtcaccgtctcctca

SEQ ID NO: 34 - protein, 125 aa, Artificial Sequence; identical to SEQ ID NO: 18
  Description of Artificial Sequence: Synthetic Heavy chain variable region amino acid sequence

SEQ ID NO: 35 - protein, 9 aa, Artificial Sequence
  Description of Artificial Sequence: Synthetic Heavy chain variable region CDR H1 amino acid sequence
FTFDTYAMN

SEQ ID NO: 36 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 37 - protein, 19 aa, Artificial Sequence
  Description of Artificial Sequence: Synthetic Heavy chain variable region CDR H2 amino acid sequence
RIRSKYNNYATYYADSVKD

SEQ ID NO: 38 - DNA, 57 bp, Artificial Sequence; identical to SEQ ID NO: 6
  Description of Artificial Sequence: Synthetic Heavy chain variable region CDR H2 nucleic acid sequence

SEQ ID NO: 39 - protein, 16 aa, Artificial Sequence
  Description of Artificial Sequence: Synthetic Heavy chain variable region CDR H3 amino acid sequence
VRHGNFGNGYVSWFAH

SEQ ID NO: 40 - DNA, 48 bp, Artificial Sequence; identical to SEQ ID NO: 24
  Description of Artificial Sequence: Synthetic Heavy chain variable region CDR H3 nucleic acid sequence

SEQ ID NO: 41 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtagatcaagcactggcgcagtcactactagtaactacgccaactgggtccagcagaccccaggccaggctccgcgcggactcatcggcggcacaaacaagcgcgctcctggggtccctgatcgcttctctggctccctgcttggggacaaagctgccctcaccatcacgggggcccaggcagatgatgaagctgattattactgtgcgctgtggtacagtaacctttgggtgttcggcggagggaccaagctgaccgtccta

SEQ ID NO: 42 - protein, 109 aa, Artificial Sequence
  Description of Artificial Sequence: Synthetic Light chain variable region amino acid sequence
QTVVTQEPSLSVSPGGTVTLTCRSSTGAVTTSNYANWVQQTPGQAPRGLIGGTNKRAPGVPDRFSGSLLGDKAALTITGAQADDEADYYCALWYSNLWVFGGGTKLTVL

SEQ ID NO: 43 - protein, 14 aa, Artificial Sequence
  Description of Artificial Sequence: Synthetic Light chain variable region CDR L1 amino acid sequence
RSSTGAVTTSNYAN

SEQ ID NO: 44 - DNA, 42 bp, Artificial Sequence; identical to SEQ ID NO: 12
  Description of Artificial Sequence: Synthetic Light chain variable region CDR L1 nucleic acid sequence

SEQ ID NO: 45 - protein, 7 aa, Artificial Sequence
  Description of Artificial Sequence: Synthetic Light chain variable region CDR L2 amino acid sequence
GTNKRAP

SEQ ID NO: 46 - DNA, 21 bp, Artificial Sequence
  Description of Artificial Sequence: Synthetic Light chain variable region CDR L2 nucleic acid sequence
ggcacaaacaagcgcgctcct

SEQ ID NO: 47 - protein, 9 aa, Artificial Sequence
  Description of Artificial Sequence: Synthetic Light chain variable region CDR L3 amino acid sequence
ALWYSNLWV

SEQ ID NO: 48 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 49 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgaggctctcctgtgcagcctctggattcacctttaacacatatgccatgaattgggtccgccaggctccagggaaggggctggagtgggtcgcaaggattaggtccaagtataacaattacgctacatactacgcagactccgtgaaggatcggttcaccatctccagagacgattccaagagcacgctgtatctgcaaatgaacagcctgagagccgaggacacggcggtgtactactgcgtcaggcacagtaacttcgggaacggttatgtatcctggtttgcttactggggccaaggaaccctggtcaccgtctcctca

SEQ ID NO: 50 - protein, 125 aa, Artificial Sequence
  Description of Artificial Sequence: Synthetic Heavy chain variable region amino acid sequence
EVQLLESGGGLVQPGGSLRLSCAASGFTFNTYAMNWVRQAPGKGLEWVARIRSKYNNYATYYADSVKDRFTISRDDSKSTLYLQMNSLRAEDTAVYYCVRHSNFGNGYVSWFAYWGQGTLVTVSS

SEQ ID NO: 51 - protein, 9 aa, Artificial Sequence
  Description of Artificial Sequence: Synthetic Heavy chain variable region CDR H1 amino acid sequence
FTFNTYAMN

SEQ ID NO: 52 - DNA, 27 bp, Artificial Sequence
  Description of Artificial Sequence: Synthetic Heavy chain variable region CDR H1 nucleic acid sequence
ttcacctttaacacatatgccatgaat

SEQ ID NO: 53 - protein, 19 aa, Artificial Sequence
  Description of Artificial Sequence: Synthetic Heavy chain variable region CDR H2 amino acid sequence
RIRSKYNNYATYYADSVKD

SEQ ID NO: 54 - DNA, 57 bp, Artificial Sequence
  Description of Artificial Sequence: Synthetic Heavy chain variable region CDR H2 nucleic acid sequence
aggattaggtccaagtataacaattacgctacatactacgcagactccgtgaaggat

SEQ ID NO: 55 - protein, 16 aa, Artificial Sequence
  Description of Artificial Sequence: Synthetic Heavy chain variable region CDR H3 amino acid sequence
VRHSNFGNGYVSWFAY

SEQ ID NO: 56 - DNA, 48 bp, Artificial Sequence
  Description of Artificial Sequence: Synthetic Heavy chain variable region CDR H3 nucleic acid sequence
gtcaggcacagtaacttcgggaacggttatgtatcctggtttgcttac

SEQ ID NO: 57 - DNA, 327 bp, Artificial Sequence; identical to SEQ ID NO: 25
  Description of Artificial Sequence: Synthetic Light chain variable region nucleic acid sequence

SEQ ID NO: 58 - protein, 109 aa, Artificial Sequence; identical to SEQ ID NO: 26
  Description of Artificial Sequence: Synthetic Light chain variable region amino acid sequence

SEQ ID NO: 59 - protein, 14 aa, Artificial Sequence
  Description of Artificial Sequence: Synthetic Light chain variable region CDR L1 amino acid sequence
RSSTGAVTTSNYAN

SEQ ID NO: 60 - DNA, 42 bp, Artificial Sequence; identical to SEQ ID NO: 12
  Description of Artificial Sequence: Synthetic Light chain variable region CDR L1 nucleic acid sequence

SEQ ID NO: 61 - protein, 7 aa, Artificial Sequence
  Description of Artificial Sequence: Synthetic Light chain variable region CDR L2 amino acid sequence
GTDKRAP

SEQ ID NO: 62 - DNA, 21 bp, Artificial Sequence
  Description of Artificial Sequence: Synthetic Light chain variable region CDR L2 nucleic acid sequence
ggcacagacaagcgcgctccc

SEQ ID NO: 63 - protein, 9 aa, Artificial Sequence
  Description of Artificial Sequence: Synthetic Light chain variable region CDR L3 amino acid sequence
ALWYSNLWV

SEQ ID NO: 64 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 65 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggtccgccaggctccagggaaggggctggagtgggtcgcaaggattagatccaagtataacaattacgctacatactacgcagactccgtgaagggtcggttcaccatctccagagacgattccaagagcacgctgtatctgcaagtgaacagcctgagagccgaggacacggcggtgtactactgcgtcaggcacggtaacttcgggaacagttacgtatcctggtttgctcattggggccaaggaaccctggtcaccgtctcctca

SEQ ID NO: 66 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKGRFTISRDDSKSTLYLQVNSLRAEDTAVYYCVRHGNFGNSYVSWFAHWGQGTLVTVSS

SEQ ID NO: 67 - protein, 9 aa, Artificial Sequence
  Description of Artificial Sequence: Synthetic Heavy chain variable region CDR H1 amino acid sequence
FTFDTYAMN

SEQ ID NO: 68 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 69 - protein, 19 aa, Artificial Sequence
  Description of Artificial Sequence: Synthetic Heavy chain variable region CDR H2 amino acid sequence
RIRSKYNNYATYYADSVKG

SEQ ID NO: 70 - DNA, 57 bp, Artificial Sequence
  Description of Artificial Sequence: Synthetic Heavy chain variable region CDR H2 nucleic acid sequence
aggattagatccaagtataacaattacgctacatactacgcagactccgtgaagggt

SEQ ID NO: 71 - protein, 16 aa, Artificial Sequence
  Description of Artificial Sequence: Synthetic Heavy chain variable region CDR H3 amino acid sequence
VRHGNFGNSYVSWFAH

SEQ ID NO: 72 - DNA, 48 bp, Artificial Sequence
  Description of Artificial Sequence: Synthetic Heavy chain variable region CDR H3 nucleic acid sequence
gtcaggcacggtaacttcgggaacagttacgtatcctggtttgctcat

SEQ ID NO: 73 - DNA, 327 bp, Artificial Sequence; identical to SEQ ID NO: 25
  Description of Artificial Sequence: Synthetic Light chain variable region nucleic acid sequence

SEQ ID NO: 74 - protein, 109 aa, Artificial Sequence; identical to SEQ ID NO: 26
  Description of Artificial Sequence: Synthetic Light chain variable region amino acid sequence

SEQ ID NO: 75 - protein, 14 aa, Artificial Sequence
  Description of Artificial Sequence: Synthetic Light chain variable region CDR L1 amino acid sequence
RSSTGAVTTSNYAN

SEQ ID NO: 76 - DNA, 42 bp, Artificial Sequence; identical to SEQ ID NO: 12
  Description of Artificial Sequence: Synthetic Light chain variable region CDR L1 nucleic acid sequence

SEQ ID NO: 77 - protein, 7 aa, Artificial Sequence
  Description of Artificial Sequence: Synthetic Light chain variable region CDR L2 amino acid sequence
GTDKRAP

SEQ ID NO: 78 - DNA, 21 bp, Artificial Sequence
  Description of Artificial Sequence: Synthetic Light chain variable region CDR L2 nucleic acid sequence
ggcacagacaagcgcgctccc

SEQ ID NO: 79 - protein, 9 aa, Artificial Sequence
  Description of Artificial Sequence: Synthetic Light chain variable region CDR L3 amino acid sequence
ALWYSNLWV

SEQ ID NO: 80 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 81 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggtccgccaggctccagggaaggggctggagtgggtcgcaaggattagatccaagtataacaattacgctacatactacgcagactccgtgaaggatcggttcaccatctccagagacgattccaagagcacgctgtatctgcaaatgaacagcctgagagccgaggacacggcggtgtactactgcgtcaggcacggtaacttcgggaacagttacgtatcctggtttgctcattggggccaaggaaccctggtcaccgtctcctca

SEQ ID NO: 82 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMNSLRAEDTAVYYCVRHGNFGNSYVSWFAHWGQGTLVTVSS

SEQ ID NO: 83 - protein, 9 aa, Artificial Sequence
  Description of Artificial Sequence: Synthetic Heavy chain variable region CDR H1 amino acid sequence
FTFDTYAMN

SEQ ID NO: 84 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 85 - protein, 19 aa, Artificial Sequence
  Description of Artificial Sequence: Synthetic Heavy chain variable region CDR H2 amino acid sequence
RIRSKYNNYATYYADSVKD

SEQ ID NO: 86 - DNA, 57 bp, Artificial Sequence; identical to SEQ ID NO: 6
  Description of Artificial Sequence: Synthetic Heavy chain variable region CDR H2 nucleic acid sequence

SEQ ID NO: 87 - protein, 16 aa, Artificial Sequence
  Description of Artificial Sequence: Synthetic Heavy chain variable region CDR H3 amino acid sequence
VRHGNFGNSYVSWFAH

SEQ ID NO: 88 - DNA, 48 bp, Artificial Sequence; identical to SEQ ID NO: 72
  Description of Artificial Sequence: Synthetic Heavy chain variable region CDR H3 nucleic acid sequence

SEQ ID NO: 89 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtagatcaagcactggcgcagtcactactagtaactacgccaactggatccagcagaccccaggccaggccccgcgcggactcatcggcggcacaaacaagcgcgctcctggggtccctgatcgcctctctggctccctgcttggggacaaagctgccctcaccatcacgggggcccaggcagatgatgaagctgattattactgtgcgctgtggtacagtaacctttgggtgttcggcggagggaccaagctgaccgtccta

SEQ ID NO: 90 - protein, 109 aa, Artificial Sequence
  Description of Artificial Sequence: Synthetic Light chain variable region amino acid sequence
QTVVTQEPSLSVSPGGTVTLTCRSSTGAVTTSNYANWIQQTPGQAPRGLIGGTNKRAPGVPDRLSGSLLGDKAALTITGAQADDEADYYCALWYSNLWVFGGGTKLTVL

SEQ ID NO: 91 - protein, 14 aa, Artificial Sequence
  Description of Artificial Sequence: Synthetic Light chain variable region CDR L1 amino acid sequence
RSSTGAVTTSNYAN

SEQ ID NO: 92 - DNA, 42 bp, Artificial Sequence; identical to SEQ ID NO: 12
  Description of Artificial Sequence: Synthetic Light chain variable region CDR L1 nucleic acid sequence

SEQ ID NO: 93 - protein, 7 aa, Artificial Sequence
  Description of Artificial Sequence: Synthetic Light chain variable region CDR L2 amino acid sequence
GTNKRAP

SEQ ID NO: 94 - DNA, 21 bp, Artificial Sequence
  Description of Artificial Sequence: Synthetic Light chain variable region CDR L2 nucleic acid sequence
ggcacaaacaagcgcgctcct

SEQ ID NO: 95 - protein, 9 aa, Artificial Sequence
  Description of Artificial Sequence: Synthetic Light chain variable region CDR L3 amino acid sequence
ALWYSNLWV

SEQ ID NO: 96 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 97 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggtccgccaggctccggggaaggggctggagtgggtcgcaaggattagatccaagtataacaattacgctacgtactacgcagactccgtgaaggatcggttcaccatctccagagacgattccaagagcacgctgtacctgcaaataaacagcctgagagccgaggacacggcggtgtactactgcgtcaggcacggtaacttcgggaacagttacgtatcctggtttgctcattggggccaaggagccctggtcaccgtctcctca

SEQ ID NO: 98 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQINSLRAEDTAVYYCVRHGNFGNSYVSWFAHWGQGALVTVSS

SEQ ID NO: 99 - protein, 9 aa, Artificial Sequence
  Description of Artificial Sequence: Synthetic Heavy chain variable region CDR H1 amino acid sequence
FTFDTYAMN

SEQ ID NO: 100 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 101 - protein, 19 aa, Artificial Sequence
  Description of Artificial Sequence: Synthetic Heavy chain variable region CDR H2 amino acid sequence
RIRSKYNNYATYYADSVKD

SEQ ID NO: 102 - DNA, 57 bp, Artificial Sequence
  Description of Artificial Sequence: Synthetic Heavy chain variable region CDR H2 nucleic acid sequence
aggattagatccaagtataacaattacgctacgtactacgcagactccgtgaaggat

SEQ ID NO: 103 - protein, 16 aa, Artificial Sequence
  Description of Artificial Sequence: Synthetic Heavy chain variable region CDR H3 amino acid sequence
VRHGNFGNSYVSWFAH

SEQ ID NO: 104 - DNA, 48 bp, Artificial Sequence; identical to SEQ ID NO: 72
  Description of Artificial Sequence: Synthetic Heavy chain variable region CDR H3 nucleic acid sequence

SEQ ID NO: 105 - DNA, 327 bp, Artificial Sequence; identical to SEQ ID NO: 25
  Description of Artificial Sequence: Synthetic Light chain variable region nucleic acid sequence

SEQ ID NO: 106 - protein, 109 aa, Artificial Sequence; identical to SEQ ID NO: 26
  Description of Artificial Sequence: Synthetic Light chain variable region amino acid sequence

SEQ ID NO: 107 - protein, 14 aa, Artificial Sequence
  Description of Artificial Sequence: Synthetic Light chain variable region CDR L1 amino acid sequence
RSSTGAVTTSNYAN

SEQ ID NO: 108 - DNA, 42 bp, Artificial Sequence; identical to SEQ ID NO: 12
  Description of Artificial Sequence: Synthetic Light chain variable region CDR L1 nucleic acid sequence

SEQ ID NO: 109 - protein, 7 aa, Artificial Sequence
  Description of Artificial Sequence: Synthetic Light chain variable region CDR L2 amino acid sequence
GTDKRAP

SEQ ID NO: 110 - DNA, 21 bp, Artificial Sequence
  Description of Artificial Sequence: Synthetic Light chain variable region CDR L2 nucleic acid sequence
ggcacagacaagcgcgctccc

SEQ ID NO: 111 - protein, 9 aa, Artificial Sequence
  Description of Artificial Sequence: Synthetic Light chain variable region CDR L3 amino acid sequence
ALWYSNLWV

SEQ ID NO: 112 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 113 - DNA, 375 bp, Artificial Sequence; identical to SEQ ID NO: 81
  Description of Artificial Sequence: Synthetic Heavy chain variable region nucleic acid sequence

SEQ ID NO: 114 - protein, 125 aa, Artificial Sequence; identical to SEQ ID NO: 82
  Description of Artificial Sequence: Synthetic Heavy chain variable region amino acid sequence

SEQ ID NO: 115 - protein, 9 aa, Artificial Sequence
  Description of Artificial Sequence: Synthetic Heavy chain variable region CDR H1 amino acid sequence
FTFDTYAMN

SEQ ID NO: 116 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 117 - protein, 19 aa, Artificial Sequence
  Description of Artificial Sequence: Synthetic Heavy chain variable region CDR H2 amino acid sequence
RIRSKYNNYATYYADSVKD

SEQ ID NO: 118 - DNA, 57 bp, Artificial Sequence; identical to SEQ ID NO: 6
  Description of Artificial Sequence: Synthetic Heavy chain variable region CDR H2 nucleic acid sequence

SEQ ID NO: 119 - protein, 16 aa, Artificial Sequence
  Description of Artificial Sequence: Synthetic Heavy chain variable region CDR H3 amino acid sequence
VRHGNFGNSYVSWFAH

SEQ ID NO: 120 - DNA, 48 bp, Artificial Sequence; identical to SEQ ID NO: 72
  Description of Artificial Sequence: Synthetic Heavy chain variable region CDR H3 nucleic acid sequence

SEQ ID NO: 121 - DNA, 327 bp, Artificial Sequence
  Description of Artificial Sequence: Synthetic Light chain variable region nucleic acid sequence
cagactgtggtgacccaggagccatcgctctcggtgtcccctggagggacagtcacactcacttgtagatcaagcactggcgcagtcactactagtaactacgccaactgggtccagcagaccccaggccaggctccgcgcggactcatcggcggcacagacaagcgcgctcccggggtccctgagcgcttctctggctccctgcttggggacaaagctgccctcaccatcacgggggcccaggcagaggatgaatctgattattactgtgtgctgtggtacagtaacctttgggtgttcggcggagggaccaagctgaccgtccta

SEQ ID NO: 122 - protein, 109 aa, Artificial Sequence
  Description of Artificial Sequence: Synthetic Light chain variable region amino acid sequence
QTVVTQEPSLSVSPGGTVTLTCRSSTGAVTTSNYANWVQQTPGQAPRGLIGGTDKRAPGVPERFSGSLLGDKAALTITGAQAEDESDYYCVLWYSNLWVFGGGTKLTVL

SEQ ID NO: 123 - protein, 14 aa, Artificial Sequence
  Description of Artificial Sequence: Synthetic Light chain variable region CDR L1 amino acid sequence
RSSTGAVTTSNYAN

SEQ ID NO: 124 - DNA, 42 bp, Artificial Sequence; identical to SEQ ID NO: 12
  Description of Artificial Sequence: Synthetic Light chain variable region CDR L1 nucleic acid sequence

SEQ ID NO: 125 - protein, 7 aa, Artificial Sequence
  Description of Artificial Sequence: Synthetic Light chain variable region CDR L2 amino acid sequence
GTDKRAP

SEQ ID NO: 126 - DNA, 21 bp, Artificial Sequence
  Description of Artificial Sequence: Synthetic Light chain variable region CDR L2 nucleic acid sequence
ggcacagacaagcgcgctccc

SEQ ID NO: 127 - protein, 9 aa, Artificial Sequence
  Description of Artificial Sequence: Synthetic Light chain variable region CDR L3 amino acid sequence
VLWYSNLWV

SEQ ID NO: 128 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 129 - DNA, 375 bp, Artificial Sequence; identical to SEQ ID NO: 81
  Description of Artificial Sequence: Synthetic Heavy chain variable region nucleic acid sequence

SEQ ID NO: 130 - protein, 125 aa, Artificial Sequence; identical to SEQ ID NO: 82
  Description of Artificial Sequence: Synthetic Heavy chain variable region amino acid sequence

SEQ ID NO: 131 - protein, 9 aa, Artificial Sequence
  Description of Artificial Sequence: Synthetic Heavy chain variable region CDR H1 amino acid sequence
FTFDTYAMN

SEQ ID NO: 132 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 133 - protein, 19 aa, Artificial Sequence
  Description of Artificial Sequence: Synthetic Heavy chain variable region CDR H2 amino acid sequence
RIRSKYNNYATYYADSVKD

SEQ ID NO: 134 - DNA, 57 bp, Artificial Sequence; identical to SEQ ID NO: 6
  Description of Artificial Sequence: Synthetic Heavy chain variable region CDR H2 nucleic acid sequence

SEQ ID NO: 135 - protein, 16 aa, Artificial Sequence
  Description of Artificial Sequence: Synthetic Heavy chain variable region CDR H3 amino acid sequence
VRHGNFGNSYVSWFAH

SEQ ID NO: 136 - DNA, 48 bp, Artificial Sequence; identical to SEQ ID NO: 72
  Description of Artificial Sequence: Synthetic Heavy chain variable region CDR H3 nucleic acid sequence

SEQ ID NO: 137 - DNA, 327 bp, Artificial Sequence
  Description of Artificial Sequence: Synthetic Light chain variable region nucleic acid sequence
cagactgtggtgacccaggagccatcgctctcggtgtcccctggagggacagtcacactcacttgtagatcaagcactggcgcagtcactactagtaactacgccaactgggtccagcagaccccaggccaggctccgcgcggactcatcggcggcacagacaagcgcgctcccggggtccctgatcgcttctctggctccctgctcggggacaaagctgccctcaccatcacgggggcccaggcagaggatgaatctgattattactgtgcgctgtggtacagtaaccattgggtgttcggcggagggaccaagctgaccgtccta

SEQ ID NO: 138 - protein, 109 aa, Artificial Sequence
  Description of Artificial Sequence: Synthetic Light chain variable region amino acid sequence
QTVVTQEPSLSVSPGGTVTLTCRSSTGAVTTSNYANWVQQTPGQAPRGLIGGTDKRAPGVPDRFSGSLLGDKAALTITGAQAEDESDYYCALWYSNHWVFGGGTKLTVL

SEQ ID NO: 139 - protein, 14 aa, Artificial Sequence
  Description of Artificial Sequence: Synthetic Light chain variable region CDR L1 amino acid sequence
RSSTGAVTTSNYAN

SEQ ID NO: 140 - DNA, 42 bp, Artificial Sequence; identical to SEQ ID NO: 12
  Description of Artificial Sequence: Synthetic Light chain variable region CDR L1 nucleic acid sequence

SEQ ID NO: 141 - protein, 7 aa, Artificial Sequence
  Description of Artificial Sequence: Synthetic Light chain variable region CDR L2 amino acid sequence
GTDKRAP

SEQ ID NO: 142 - DNA, 21 bp, Artificial Sequence
  Description of Artificial Sequence: Synthetic Light chain variable region CDR L2 nucleic acid sequence
ggcacagacaagcgcgctccc

SEQ ID NO: 143 - protein, 9 aa, Artificial Sequence
  Description of Artificial Sequence: Synthetic Light chain variable region CDR L3 amino acid sequence
ALWYSNHWV

SEQ ID NO: 144 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 145 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggtccgccaggctccagggaaggggctggagtgggtcgcaaggattagatccaagtataacaattacgctacatactacgcagactccgtgaaggatcggttcgccatctccagagacgattccaagagcacgctgtatctgcaaatgaacagcctgagagccgaggacacggcggtgtactactgcgtcaggcacagtaacttcgggaacagttacgtatcctggtttgctcattggggccaaggaaccctggtcaccgtctcctca

SEQ ID NO: 146 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFAISRDDSKSTLYLQMNSLRAEDTAVYYCVRHSNFGNSYVSWFAHWGQGTLVTVSS

SEQ ID NO: 147 - protein, 9 aa, Artificial Sequence
  Description of Artificial Sequence: Synthetic Heavy chain variable region CDR H1 amino acid sequence
FTFDTYAMN

SEQ ID NO: 148 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 149 - protein, 19 aa, Artificial Sequence
  Description of Artificial Sequence: Synthetic Heavy chain variable region CDR H2 amino acid sequence
RIRSKYNNYATYYADSVKD

SEQ ID NO: 150 - DNA, 57 bp, Artificial Sequence; identical to SEQ ID NO: 6
  Description of Artificial Sequence: Synthetic Heavy chain variable region CDR H2 nucleic acid sequence

SEQ ID NO: 151 - protein, 16 aa, Artificial Sequence
  Description of Artificial Sequence: Synthetic Heavy chain variable region CDR H3 amino acid sequence
VRHSNFGNSYVSWFAH

SEQ ID NO: 152 - DNA, 48 bp, Artificial Sequence
  Description of Artificial Sequence: Synthetic Heavy chain variable region CDR H3 nucleic acid sequence
gtcaggcacagtaacttcgggaacagttacgtatcctggtttgctcat

SEQ ID NO: 153 - DNA, 327 bp, Artificial Sequence; identical to SEQ ID NO: 41
  Description of Artificial Sequence: Synthetic Light chain variable region nucleic acid sequence

SEQ ID NO: 154 - protein, 109 aa, Artificial Sequence; identical to SEQ ID NO: 42
  Description of Artificial Sequence: Synthetic Light chain variable region amino acid sequence

SEQ ID NO: 155 - protein, 14 aa, Artificial Sequence
  Description of Artificial Sequence: Synthetic Light chain variable region CDR L1 amino acid sequence
RSSTGAVTTSNYAN

SEQ ID NO: 156 - DNA, 42 bp, Artificial Sequence; identical to SEQ ID NO: 12
  Description of Artificial Sequence: Synthetic Light chain variable region CDR L1 nucleic acid sequence

SEQ ID NO: 157 - protein, 7 aa, Artificial Sequence
  Description of Artificial Sequence: Synthetic Light chain variable region CDR L2 amino acid sequence
GTNKRAP

SEQ ID NO: 158 - DNA, 21 bp, Artificial Sequence
  Description of Artificial Sequence: Synthetic Light chain variable region CDR L2 nucleic acid sequence
ggcacaaacaagcgcgctcct

SEQ ID NO: 159 - protein, 9 aa, Artificial Sequence
  Description of Artificial Sequence: Synthetic Light chain variable region CDR L3 amino acid sequence
ALWYSNLWV

SEQ ID NO: 160 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 161 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctctgccacatatgccatgaattgggtccgccaggctccagggaaggggctggagtgggtcgcaaggattagatccaagtataacaattacgctacatactacgcagactccgtgaaggatcggttcaccatctccagagacgattccaagagcacgctgtatctgcaaatgaacagcctgagagccgaggacacggcggtgtactactgcgtcaggcacggtaacttcgggaacagtcacgtatcctggtttgctcattggggccaaggaaccctggtcaccgtctcctca

SEQ ID NO: 162 - protein, 125 aa, Artificial Sequence
  Description of Artificial Sequence: Synthetic Heavy chain variable region amino acid sequence
EVQLLESGGGLVQPGGSLRLSCAASGFTSATYAMNWVRQAPGKGLEWVARIRSKYNNYATYYADSVKDRFTISRDDSKSTLYLQMNSLRAEDTAVYYCVRHGNFGNSHVSWFAHWGQGTLVTVSS

SEQ ID NO: 163 - protein, 9 aa, Artificial Sequence
  Description of Artificial Sequence: Synthetic Heavy chain variable region CDR H1 amino acid sequence
FTSATYAMN

SEQ ID NO: 164 - DNA, 27 bp, Artificial Sequence
  Description of Artificial Sequence: Synthetic Heavy chain variable region CDR H1 nucleic acid sequence
ttcacctctgccacatatgccatgaat

SEQ ID NO: 165 - protein, 19 aa, Artificial Sequence
  Description of Artificial Sequence: Synthetic Heavy chain variable region CDR H2 amino acid sequence
RIRSKYNNYATYYADSVKD

SEQ ID NO: 166 - DNA, 57 bp, Artificial Sequence; identical to SEQ ID NO: 6
  Description of Artificial Sequence: Synthetic Heavy chain variable region CDR H2 nucleic acid sequence

SEQ ID NO: 167 - protein, 16 aa, Artificial Sequence
  Description of Artificial Sequence: Synthetic Heavy chain variable region CDR H3 amino acid sequence
VRHGNFGNSHVSWFAH

SEQ ID NO: 168 - DNA, 48 bp, Artificial Sequence
  Description of Artificial Sequence: Synthetic Heavy chain variable region CDR H3 nucleic acid sequence
gtcaggcacggtaacttcgggaacagtcacgtatcctggtttgctcat

SEQ ID NO: 169 - DNA, 327 bp, Artificial Sequence; identical to SEQ ID NO: 41
  Description of Artificial Sequence: Synthetic Light chain variable region nucleic acid sequence

SEQ ID NO: 170 - protein, 109 aa, Artificial Sequence; identical to SEQ ID NO: 42
  Description of Artificial Sequence: Synthetic Light chain variable region amino acid sequence

SEQ ID NO: 171 - protein, 14 aa, Artificial Sequence
  Description of Artificial Sequence: Synthetic Light chain variable region CDR L1 amino acid sequence
RSSTGAVTTSNYAN

SEQ ID NO: 172 - DNA, 42 bp, Artificial Sequence; identical to SEQ ID NO: 12
  Description of Artificial Sequence: Synthetic Light chain variable region CDR L1 nucleic acid sequence

SEQ ID NO: 173 - protein, 7 aa, Artificial Sequence
  Description of Artificial Sequence: Synthetic Light chain variable region CDR L2 amino acid sequence
GTNKRAP

SEQ ID NO: 174 - DNA, 21 bp, Artificial Sequence
  Description of Artificial Sequence: Synthetic Light chain variable region CDR L2 nucleic acid sequence
ggcacaaacaagcgcgctcct

SEQ ID NO: 175 - protein, 9 aa, Artificial Sequence
  Description of Artificial Sequence: Synthetic Light chain variable region CDR L3 amino acid sequence
ALWYSNLWV

SEQ ID NO: 176 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 177 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttaacacatatgccatgaattgggtccgccaggctccagggaaggggctggagtgggtcgcaaggattagatccaagtataacaattacgctacatactacgcagactccgtgaaggatcggttcaccatctccagagacgattccaagaacacgctgtatctgcaaatgaacagcctgagagccgaggacacggcggtgtactactgcgtcaggcacggtaacttcgggaacagttatgtatcctggtttgcttcttggggccaaggaaccctggtcaccgtctcctca

SEQ ID NO: 178 - protein, 125 aa, Artificial Sequence
  Description of Artificial Sequence: Synthetic Heavy chain variable region amino acid sequence
EVQLLESGGGLVQPGGSLRLSCAASGFTFNTYAMNWVRQAPGKGLEWVARIRSKYNNYATYYADSVKDRFTISRDDSKNTLYLQMNSLRAEDTAVYYCVRHGNFGNSYVSWFASWGQGTLVTVSS

SEQ ID NO: 179 - protein, 9 aa, Artificial Sequence
  Description of Artificial Sequence: Synthetic Heavy chain variable region CDR H1 amino acid sequence
FTFNTYAMN

SEQ ID NO: 180 - DNA, 27 bp, Artificial Sequence
  Description of Artificial Sequence: Synthetic Heavy chain variable region CDR H1 nucleic acid sequence
ttcacctttaacacatatgccatgaat

SEQ ID NO: 181 - protein, 19 aa, Artificial Sequence
  Description of Artificial Sequence: Synthetic Heavy chain variable region CDR H2 amino acid sequence
RIRSKYNNYATYYADSVKD

SEQ ID NO: 182 - DNA, 57 bp, Artificial Sequence; identical to SEQ ID NO: 6
  Description of Artificial Sequence: Synthetic Heavy chain variable region CDR H2 nucleic acid sequence

SEQ ID NO: 183 - protein, 16 aa, Artificial Sequence
  Description of Artificial Sequence: Synthetic Heavy chain variable region CDR H3 amino acid sequence
VRHGNFGNSYVSWFAS

SEQ ID NO: 184 - DNA, 48 bp, Artificial Sequence
  Description of Artificial Sequence: Synthetic Heavy chain variable region CDR H3 nucleic acid sequence
gtcaggcacggtaacttcgggaacagttatgtatcctggtttgcttct

SEQ ID NO: 185 - DNA, 327 bp, Artificial Sequence
  Description of Artificial Sequence: Synthetic Light chain variable region nucleic acid sequence
cagactgtggtgacccaggagccatcgttctcagtgtcccctggagggacagtcacactcacttgtggctcaagcactggcgcagtcactactagtaactacgccaactgggtccagcagaccccaggccaggctccacgcggactcatcggcggcacagacaagcgcgctcctggggtccctgatcgcttctctggctccctgcttggggacaaagctgccctcaccatcacgggggcccaggcagatgatgaatctgattattactgtgcgctgtggtacagtaacctttgggtgttcggcggagggaccaagctgaccgtccta

SEQ ID NO: 186 - protein, 109 aa, Artificial Sequence
  Description of Artificial Sequence: Synthetic Light chain variable region amino acid sequence
QTVVTQEPSFSVSPGGTVTLTCGSSTGAVTTSNYANWVQQTPGQAPRGLIGGTDKRAPGVPDRFSGSLLGDKAALTITGAQADDESDYYCALWYSNLWVFGGGTKLTVL

SEQ ID NO: 187 - protein, 14 aa, Artificial Sequence
  Description of Artificial Sequence: Synthetic Light chain variable region CDR L1 amino acid sequence
GSSTGAVTTSNYAN

SEQ ID NO: 188 - DNA, 42 bp, Artificial Sequence
  Description of Artificial Sequence: Synthetic Light chain variable region CDR L1 nucleic acid sequence
ggctcaagcactggcgcagtcactactagtaactacgccaac

SEQ ID NO: 189 - protein, 7 aa, Artificial Sequence
  Description of Artificial Sequence: Synthetic Light chain variable region CDR L2 amino acid sequence
GTDKRAP

SEQ ID NO: 190 - DNA, 21 bp, Artificial Sequence
  Description of Artificial Sequence: Synthetic Light chain variable region CDR L2 nucleic acid sequence
ggcacagacaagcgcgctcct

SEQ ID NO: 191 - protein, 9 aa, Artificial Sequence
  Description of Artificial Sequence: Synthetic Light chain variable region CDR L3 amino acid sequence
ALWYSNLWV

SEQ ID NO: 192 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 193 - DNA, 375 bp, Artificial Sequence; identical to SEQ ID NO: 17
  Description of Artificial Sequence: Synthetic Heavy chain variable region nucleic acid sequence

SEQ ID NO: 194 - protein, 125 aa, Artificial Sequence; identical to SEQ ID NO: 18
  Description of Artificial Sequence: Synthetic Heavy chain variable region amino acid sequence

SEQ ID NO: 195 - protein, 9 aa, Artificial Sequence
  Description of Artificial Sequence: Synthetic Heavy chain variable region CDR H1 amino acid sequence
FTFDTYAMN

SEQ ID NO: 196 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 197 - protein, 19 aa, Artificial Sequence
  Description of Artificial Sequence: Synthetic Heavy chain variable region CDR H2 amino acid sequence
RIRSKYNNYATYYADSVKD

SEQ ID NO: 198 - DNA, 57 bp, Artificial Sequence; identical to SEQ ID NO: 6
  Description of Artificial Sequence: Synthetic Heavy chain variable region CDR H2 nucleic acid sequence

SEQ ID NO: 199 - protein, 16 aa, Artificial Sequence
  Description of Artificial Sequence: Synthetic Heavy chain variable region CDR H3 amino acid sequence
VRHGNFGNGYVSWFAH

SEQ ID NO: 200 - DNA, 48 bp, Artificial Sequence; identical to SEQ ID NO: 24
  Description of Artificial Sequence: Synthetic Heavy chain variable region CDR H3 nucleic acid sequence

SEQ ID NO: 201 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcatcatcacgggggcccaggcagatgatgaagctgattattactgtgcgctgtggtacagtaaccattgggtgttcggcggagggaccaagctgaccgtccta

SEQ ID NO: 202 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALIITGAQADDEADYYCALWYSNHWVFGGGTKLTVL

SEQ ID NO: 203 - protein, 14 aa, Artificial Sequence
  Description of Artificial Sequence: Synthetic Light chain variable region CDR L1 amino acid sequence
GSSTGAVTTSNYAN

SEQ ID NO: 204 - DNA, 42 bp, Artificial Sequence
  Description of Artificial Sequence: Synthetic Light chain variable region CDR L1 nucleic acid sequence
ggatcaagcactggcgcagtcactactagtaactacgccaac

SEQ ID NO: 205 - protein, 7 aa, Artificial Sequence
  Description of Artificial Sequence: Synthetic Light chain variable region CDR L2 amino acid sequence
GTDKRAP

SEQ ID NO: 206 - DNA, 21 bp, Artificial Sequence
  Description of Artificial Sequence: Synthetic Light chain variable region CDR L2 nucleic acid sequence
ggcacagacaagcgcgctcct

SEQ ID NO: 207 - protein, 9 aa, Artificial Sequence
  Description of Artificial Sequence: Synthetic Light chain variable region CDR L3 amino acid sequence
ALWYSNHWV

SEQ ID NO: 208 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 209 - DNA, 375 bp, Artificial Sequence; identical to SEQ ID NO: 17
  Description of Artificial Sequence: Synthetic Heavy chain variable region nucleic acid sequence

SEQ ID NO: 210 - protein, 125 aa, Artificial Sequence; identical to SEQ ID NO: 18
  Description of Artificial Sequence: Synthetic Heavy chain variable region amino acid sequence

SEQ ID NO: 211 - protein, 9 aa, Artificial Sequence
  Description of Artificial Sequence: Synthetic Heavy chain variable region CDR H1 amino acid sequence
FTFDTYAMN

SEQ ID NO: 212 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 213 - protein, 19 aa, Artificial Sequence
  Description of Artificial Sequence: Synthetic Heavy chain variable region CDR H2 amino acid sequence
RIRSKYNNYATYYADSVKD

SEQ ID NO: 214 - DNA, 57 bp, Artificial Sequence; identical to SEQ ID NO: 6
  Description of Artificial Sequence: Synthetic Heavy chain variable region CDR H2 nucleic acid sequence

SEQ ID NO: 215 - protein, 16 aa, Artificial Sequence
  Description of Artificial Sequence: Synthetic Heavy chain variable region CDR H3 amino acid sequence
VRHGNFGNGYVSWFAH

SEQ ID NO: 216 - DNA, 48 bp, Artificial Sequence; identical to SEQ ID NO: 24
  Description of Artificial Sequence: Synthetic Heavy chain variable region CDR H3 nucleic acid sequence

SEQ ID NO: 217 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggtccaggcagatgatgaagctgattattactgtgcgctgtggtacagtaaccattgggtgttcggcggagggaccaagctgaccgtccta

SEQ ID NO: 218 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGVQADDEADYYCALWYSNHWVFGGGTKLTVL

SEQ ID NO: 219 - protein, 14 aa, Artificial Sequence
  Description of Artificial Sequence: Synthetic Light chain variable region CDR L1 amino acid sequence
GSSTGAVTTSNYAN

SEQ ID NO: 220 - DNA, 42 bp, Artificial Sequence; identical to SEQ ID NO: 204
  Description of Artificial Sequence: Synthetic Light chain variable region CDR L1 nucleic acid sequence

SEQ ID NO: 221 - protein, 7 aa, Artificial Sequence
  Description of Artificial Sequence: Synthetic Light chain variable region CDR L2 amino acid sequence
GTDKRAP

SEQ ID NO: 222 - DNA, 21 bp, Artificial Sequence
  Description of Artificial Sequence: Synthetic Light chain variable region CDR L2 nucleic acid sequence
ggcacagacaagcgcgctcct

SEQ ID NO: 223 - protein, 9 aa, Artificial Sequence
  Description of Artificial Sequence: Synthetic Light chain variable region CDR L3 amino acid sequence
ALWYSNHWV

SEQ ID NO: 224 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 225 - DNA, 375 bp, Artificial Sequence; identical to SEQ ID NO: 17
  Description of Artificial Sequence: Synthetic Heavy chain variable region nucleic acid sequence

SEQ ID NO: 226 - protein, 125 aa, Artificial Sequence; identical to SEQ ID NO: 18
  Description of Artificial Sequence: Synthetic Heavy chain variable region amino acid sequence

SEQ ID NO: 227 - protein, 9 aa, Artificial Sequence
  Description of Artificial Sequence: Synthetic Heavy chain variable region CDR H1 amino acid sequence
FTFDTYAMN

SEQ ID NO: 228 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 229 - protein, 19 aa, Artificial Sequence
  Description of Artificial Sequence: Synthetic Heavy chain variable region CDR H2 amino acid sequence
RIRSKYNNYATYYADSVKD

SEQ ID NO: 230 - DNA, 57 bp, Artificial Sequence; identical to SEQ ID NO: 6
  Description of Artificial Sequence: Synthetic Heavy chain variable region CDR H2 nucleic acid sequence

SEQ ID NO: 231 - protein, 16 aa, Artificial Sequence
  Description of Artificial Sequence: Synthetic Heavy chain variable region CDR H3 amino acid sequence
VRHGNFGNGYVSWFAH

SEQ ID NO: 232 - DNA, 48 bp, Artificial Sequence; identical to SEQ ID NO: 24
  Description of Artificial Sequence: Synthetic Heavy chain variable region CDR H3 nucleic acid sequence

SEQ ID NO: 233 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcgctggcgcagtcactactagtaactacgccaactgggtccagcagaccccaggccaggctccacgcggactcatcggcggcacagacaagcgcgctcctggggtccctgatcgcttctctggctccctgcttggggacaaagctgccctcaccatcacgggggcccaggcagatgatgaagctgattattactgtgtgctgtggtacagtaacctttgggtgttcggcggagggaccaagctgaccgtccta

SEQ ID NO: 234 - protein, 109 aa, Artificial Sequence
  Description of Artificial Sequence: Synthetic Light chain variable region amino acid sequence
QTVVTQEPSLSVSPGGTVTLTCGSSAGAVTTSNYANWVQQTPGQAPRGLIGGTDKRAPGVPDRFSGSLLGDKAALTITGAQADDEADYYCVLWYSNLWVFGGGTKLTVL

SEQ ID NO: 235 - protein, 14 aa, Artificial Sequence
  Description of Artificial Sequence: Synthetic Light chain variable region CDR L1 amino acid sequence
GSSAGAVTTSNYAN

SEQ ID NO: 236 - DNA, 42 bp, Artificial Sequence
  Description of Artificial Sequence: Synthetic Light chain variable region CDR L1 nucleic acid sequence
ggatcaagcgctggcgcagtcactactagtaactacgccaac

SEQ ID NO: 237 - protein, 7 aa, Artificial Sequence
  Description of Artificial Sequence: Synthetic Light chain variable region CDR L2 amino acid sequence
GTDKRAP

SEQ ID NO: 238 - DNA, 21 bp, Artificial Sequence
  Description of Artificial Sequence: Synthetic Light chain variable region CDR L2 nucleic acid sequence
ggcacagacaagcgcgctcct

SEQ ID NO: 239 - protein, 9 aa, Artificial Sequence
  Description of Artificial Sequence: Synthetic Light chain variable region CDR L3 amino acid sequence
VLWYSNLWV

SEQ ID NO: 240 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 241 - DNA, 375 bp, Artificial Sequence; identical to SEQ ID NO: 17
  Description of Artificial Sequence: Synthetic Heavy chain variable region nucleic acid sequence

SEQ ID NO: 242 - protein, 125 aa, Artificial Sequence; identical to SEQ ID NO: 18
  Description of Artificial Sequence: Synthetic Heavy chain variable region amino acid sequence

SEQ ID NO: 243 - protein, 9 aa, Artificial Sequence
  Description of Artificial Sequence: Synthetic Heavy chain variable region CDR H1 amino acid sequence
FTFDTYAMN

SEQ ID NO: 244 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 245 - protein, 19 aa, Artificial Sequence
  Description of Artificial Sequence: Synthetic Heavy chain variable region CDR H2 amino acid sequence
RIRSKYNNYATYYADSVKD

SEQ ID NO: 246 - DNA, 57 bp, Artificial Sequence; identical to SEQ ID NO: 6
  Description of Artificial Sequence: Synthetic Heavy chain variable region CDR H2 nucleic acid sequence

SEQ ID NO: 247 - protein, 16 aa, Artificial Sequence
  Description of Artificial Sequence: Synthetic Heavy chain variable region CDR H3 amino acid sequence
VRHGNFGNGYVSWFAH

SEQ ID NO: 248 - DNA, 48 bp, Artificial Sequence; identical to SEQ ID NO: 24
  Description of Artificial Sequence: Synthetic Heavy chain variable region CDR H3 nucleic acid sequence

SEQ ID NO: 249 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcgctggcgcagtcactactagtaactacgccaactgggtccagcagaccccaggccaggctccacgcggactcatcggcggcacagacaagcgcgctcctggggtccctgatcgcttctctggctccctgcttggggacaaagctgccctcaccatcacgggggcccaggcagatgatgaagctgattattactgtgcgctgtggtacagtaaccattgggtgttcggcggagggaccaagctgaccgtccta

SEQ ID NO: 250 - protein, 109 aa, Artificial Sequence
  Description of Artificial Sequence: Synthetic Light chain variable region amino acid sequence
QTVVTQEPSLSVSPGGTVTLTCGSSAGAVTTSNYANWVQQTPGQAPRGLIGGTDKRAPGVPDRFSGSLLGDKAALTITGAQADDEADYYCALWYSNHWVFGGGTKLTVL

SEQ ID NO: 251 - protein, 14 aa, Artificial Sequence
  Description of Artificial Sequence: Synthetic Light chain variable region CDR L1 amino acid sequence
GSSAGAVTTSNYAN

SEQ ID NO: 252 - DNA, 42 bp, Artificial Sequence; identical to SEQ ID NO: 236
  Description of Artificial Sequence: Synthetic Light chain variable region CDR L1 nucleic acid sequence

SEQ ID NO: 253 - protein, 7 aa, Artificial Sequence
  Description of Artificial Sequence: Synthetic Light chain variable region CDR L2 amino acid sequence
GTDKRAP

SEQ ID NO: 254 - DNA, 21 bp, Artificial Sequence
  Description of Artificial Sequence: Synthetic Light chain variable region CDR L2 nucleic acid sequence
ggcacagacaagcgcgctcct

SEQ ID NO: 255 - protein, 9 aa, Artificial Sequence
  Description of Artificial Sequence: Synthetic Light chain variable region CDR L3 amino acid sequence
ALWYSNHWV

SEQ ID NO: 256 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 257 - DNA, 375 bp, Artificial Sequence; identical to SEQ ID NO: 17
  Description of Artificial Sequence: Synthetic Heavy chain variable region nucleic acid sequence

SEQ ID NO: 258 - protein, 125 aa, Artificial Sequence; identical to SEQ ID NO: 18
  Description of Artificial Sequence: Synthetic Heavy chain variable region amino acid sequence

SEQ ID NO: 259 - protein, 9 aa, Artificial Sequence
  Description of Artificial Sequence: Synthetic Heavy chain variable region CDR H1 amino acid sequence
FTFDTYAMN

SEQ ID NO: 260 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 261 - protein, 19 aa, Artificial Sequence
  Description of Artificial Sequence: Synthetic Heavy chain variable region CDR H2 amino acid sequence
RIRSKYNNYATYYADSVKD

SEQ ID NO: 262 - DNA, 57 bp, Artificial Sequence; identical to SEQ ID NO: 6
  Description of Artificial Sequence: Synthetic Heavy chain variable region CDR H2 nucleic acid sequence

SEQ ID NO: 263 - protein, 16 aa, Artificial Sequence
  Description of Artificial Sequence: Synthetic Heavy chain variable region CDR H3 amino acid sequence
VRHGNFGNGYVSWFAH

SEQ ID NO: 264 - DNA, 48 bp, Artificial Sequence; identical to SEQ ID NO: 24
  Description of Artificial Sequence: Synthetic Heavy chain variable region CDR H3 nucleic acid sequence

SEQ ID NO: 265 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagatgatgaagctgattattactgtgcgctgtggtacaataaccattgggtgttcggcggagggaccaagctgaccgtccta

SEQ ID NO: 266 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQADDEADYYCALWYNNHWVFGGGTKLTVL

SEQ ID NO: 267 - protein, 14 aa, Artificial Sequence
  Description of Artificial Sequence: Synthetic Light chain variable region CDR L1 amino acid sequence
GSSTGAVTTSNYAN

SEQ ID NO: 268 - DNA, 42 bp, Artificial Sequence; identical to SEQ ID NO: 204
  Description of Artificial Sequence: Synthetic Light chain variable region CDR L1 nucleic acid sequence

SEQ ID NO: 269 - protein, 7 aa, Artificial Sequence
  Description of Artificial Sequence: Synthetic Light chain variable region CDR L2 amino acid sequence
GTDKRAP

SEQ ID NO: 270 - DNA, 21 bp, Artificial Sequence
  Description of Artificial Sequence: Synthetic Light chain variable region CDR L2 nucleic acid sequence
ggcacagacaagcgcgctcct

SEQ ID NO: 271 - protein, 9 aa, Artificial Sequence
  Description of Artificial Sequence: Synthetic Light chain variable region CDR L3 amino acid sequence
ALWYNNHWV

SEQ ID NO: 272 - DNA, 27 bp, Artificial Sequence
  Description of Artificial Sequence: Synthetic Light chain variable region CDR L3 nucleic acid sequence
gcgctgtggtacaataaccattgggtg

SEQ ID NO: 273 - DNA, 375 bp, Artificial Sequence; identical to SEQ ID NO: 145
  Description of Artificial Sequence: Synthetic Heavy chain variable region nucleic acid sequence

SEQ ID NO: 274 - protein, 125 aa, Artificial Sequence; identical to SEQ ID NO: 146
  Description of Artificial Sequence: Synthetic Heavy chain variable region amino acid sequence

SEQ ID NO: 275 - protein, 9 aa, Artificial Sequence
  Description of Artificial Sequence: Synthetic Heavy chain variable region CDR H1 amino acid sequence
FTFDTYAMN

SEQ ID NO: 276 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 277 - protein, 19 aa, Artificial Sequence
  Description of Artificial Sequence: Synthetic Heavy chain variable region CDR H2 amino acid sequence
RIRSKYNNYATYYADSVKD

SEQ ID NO: 278 - DNA, 57 bp, Artificial Sequence; identical to SEQ ID NO: 6
  Description of Artificial Sequence: Synthetic Heavy chain variable region CDR H2 nucleic acid sequence

SEQ ID NO: 279 - protein, 16 aa, Artificial Sequence
  Description of Artificial Sequence: Synthetic Heavy chain variable region CDR H3 amino acid sequence
VRHSNFGNSYVSWFAH

SEQ ID NO: 280 - DNA, 48 bp, Artificial Sequence; identical to SEQ ID NO: 152
  Description of Artificial Sequence: Synthetic Heavy chain variable region CDR H3 nucleic acid sequence

SEQ ID NO: 281 - DNA, 327 bp, Artificial Sequence; identical to SEQ ID NO: 233
  Description of Artificial Sequence: Synthetic Light chain variable region nucleic acid sequence

SEQ ID NO: 282 - protein, 109 aa, Artificial Sequence; identical to SEQ ID NO: 234
  Description of Artificial Sequence: Synthetic Light chain variable region amino acid sequence

SEQ ID NO: 283 - protein, 14 aa, Artificial Sequence
  Description of Artificial Sequence: Synthetic Light chain variable region CDR L1 amino acid sequence
GSSAGAVTTSNYAN

SEQ ID NO: 284 - DNA, 42 bp, Artificial Sequence; identical to SEQ ID NO: 236
  Description of Artificial Sequence: Synthetic Light chain variable region CDR L1 nucleic acid sequence

SEQ ID NO: 285 - protein, 7 aa, Artificial Sequence
  Description of Artificial Sequence: Synthetic Light chain variable region CDR L2 amino acid sequence
GTDKRAP

SEQ ID NO: 286 - DNA, 21 bp, Artificial Sequence
  Description of Artificial Sequence: Synthetic Light chain variable region CDR L2 nucleic acid sequence
ggcacagacaagcgcgctcct

SEQ ID NO: 287 - protein, 9 aa, Artificial Sequence
  Description of Artificial Sequence: Synthetic Light chain variable region CDR L3 amino acid sequence
VLWYSNLWV

SEQ ID NO: 288 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 289 - DNA, 375 bp, Artificial Sequence; identical to SEQ ID NO: 145
  Description of Artificial Sequence: Synthetic Heavy chain variable region nucleic acid sequence

SEQ ID NO: 290 - protein, 125 aa, Artificial Sequence; identical to SEQ ID NO: 146
  Description of Artificial Sequence: Synthetic Heavy chain variable region amino acid sequence

SEQ ID NO: 291 - protein, 9 aa, Artificial Sequence
  Description of Artificial Sequence: Synthetic Heavy chain variable region CDR H1 amino acid sequence
FTFDTYAMN

SEQ ID NO: 292 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 293 - protein, 19 aa, Artificial Sequence
  Description of Artificial Sequence: Synthetic Heavy chain variable region CDR H2 amino acid sequence
RIRSKYNNYATYYADSVKD

SEQ ID NO: 294 - DNA, 57 bp, Artificial Sequence; identical to SEQ ID NO: 6
  Description of Artificial Sequence: Synthetic Heavy chain variable region CDR H2 nucleic acid sequence

SEQ ID NO: 295 - protein, 16 aa, Artificial Sequence
  Description of Artificial Sequence: Synthetic Heavy chain variable region CDR H3 amino acid sequence
VRHSNFGNSYVSWFAH

SEQ ID NO: 296 - DNA, 48 bp, Artificial Sequence; identical to SEQ ID NO: 152
  Description of Artificial Sequence: Synthetic Heavy chain variable region CDR H3 nucleic acid sequence

SEQ ID NO: 297 - DNA, 327 bp, Artificial Sequence; identical to SEQ ID NO: 249
  Description of Artificial Sequence: Synthetic Light chain variable region nucleic acid sequence

SEQ ID NO: 298 - protein, 109 aa, Artificial Sequence; identical to SEQ ID NO: 250
  Description of Artificial Sequence: Synthetic Light chain variable region amino acid sequence

SEQ ID NO: 299 - protein, 14 aa, Artificial Sequence
  Description of Artificial Sequence: Synthetic Light chain variable region CDR L1 amino acid sequence
GSSAGAVTTSNYAN

SEQ ID NO: 300 - DNA, 42 bp, Artificial Sequence; identical to SEQ ID NO: 236
  Description of Artificial Sequence: Synthetic Light chain variable region CDR L1 nucleic acid sequence

SEQ ID NO: 301 - protein, 7 aa, Artificial Sequence
  Description of Artificial Sequence: Synthetic Light chain variable region CDR L2 amino acid sequence
GTDKRAP

SEQ ID NO: 302 - DNA, 21 bp, Artificial Sequence
  Description of Artificial Sequence: Synthetic Light chain variable region CDR L2 nucleic acid sequence
ggcacagacaagcgcgctcct

SEQ ID NO: 303 - protein, 9 aa, Artificial Sequence
  Description of Artificial Sequence: Synthetic Light chain variable region CDR L3 amino acid sequence
ALWYSNHWV

SEQ ID NO: 304 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 305 - DNA, 375 bp, Artificial Sequence; identical to SEQ ID NO: 145
  Description of Artificial Sequence: Synthetic Heavy chain variable region nucleic acid sequence

SEQ ID NO: 306 - protein, 125 aa, Artificial Sequence; identical to SEQ ID NO: 146
  Description of Artificial Sequence: Synthetic Heavy chain variable region amino acid sequence

SEQ ID NO: 307 - protein, 9 aa, Artificial Sequence
  Description of Artificial Sequence: Synthetic Heavy chain variable region CDR H1 amino acid sequence
FTFDTYAMN

SEQ ID NO: 308 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 309 - protein, 19 aa, Artificial Sequence
  Description of Artificial Sequence: Synthetic Heavy chain variable region CDR H2 amino acid sequence
RIRSKYNNYATYYADSVKD

SEQ ID NO: 310 - DNA, 57 bp, Artificial Sequence; identical to SEQ ID NO: 6
  Description of Artificial Sequence: Synthetic Heavy chain variable region CDR H2 nucleic acid sequence

SEQ ID NO: 311 - protein, 16 aa, Artificial Sequence
  Description of Artificial Sequence: Synthetic Heavy chain variable region CDR H3 amino acid sequence
VRHSNFGNSYVSWFAH

SEQ ID NO: 312 - DNA, 48 bp, Artificial Sequence; identical to SEQ ID NO: 152
  Description of Artificial Sequence: Synthetic Heavy chain variable region CDR H3 nucleic acid sequence

SEQ ID NO: 313 - DNA, 327 bp, Artificial Sequence; identical to SEQ ID NO: 265
  Description of Artificial Sequence: Synthetic Light chain variable region nucleic acid sequence

SEQ ID NO: 314 - protein, 109 aa, Artificial Sequence; identical to SEQ ID NO: 266
  Description of Artificial Sequence: Synthetic Light chain variable region amino acid sequence

SEQ ID NO: 315 - protein, 14 aa, Artificial Sequence
  Description of Artificial Sequence: Synthetic Light chain variable region CDR L1 amino acid sequence
GSSTGAVTTSNYAN

SEQ ID NO: 316 - DNA, 42 bp, Artificial Sequence; identical to SEQ ID NO: 204
  Description of Artificial Sequence: Synthetic Light chain variable region CDR L1 nucleic acid sequence

SEQ ID NO: 317 - protein, 7 aa, Artificial Sequence
  Description of Artificial Sequence: Synthetic Light chain variable region CDR L2 amino acid sequence
GTDKRAP

SEQ ID NO: 318 - DNA, 21 bp, Artificial Sequence
  Description of Artificial Sequence: Synthetic Light chain variable region CDR L2 nucleic acid sequence
ggcacagacaagcgcgctcct

SEQ ID NO: 319 - protein, 9 aa, Artificial Sequence
  Description of Artificial Sequence: Synthetic Light chain variable region CDR L3 amino acid sequence
ALWYNNHWV

SEQ ID NO: 320 - DNA, 27 bp, Artificial Sequence
  Description of Artificial Sequence: Synthetic Light chain variable region CDR L3 nucleic acid sequence
gcgctgtggtacaataaccattgggtg

SEQ ID NO: 321 - DNA, 375 bp, Artificial Sequence; identical to SEQ ID NO: 17
  Description of Artificial Sequence: Synthetic Heavy chain variable region nucleic acid sequence

SEQ ID NO: 322 - protein, 125 aa, Artificial Sequence; identical to SEQ ID NO: 18
  Description of Artificial Sequence: Synthetic Heavy chain variable region amino acid sequence

SEQ ID NO: 323 - protein, 9 aa, Artificial Sequence
  Description of Artificial Sequence: Synthetic Heavy chain variable region CDR H1 amino acid sequence
FTFDTYAMN

SEQ ID NO: 324 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 325 - protein, 19 aa, Artificial Sequence
  Description of Artificial Sequence: Synthetic Heavy chain variable region CDR H2 amino acid sequence
RIRSKYNNYATYYADSVKD

SEQ ID NO: 326 - DNA, 57 bp, Artificial Sequence; identical to SEQ ID NO: 6
  Description of Artificial Sequence: Synthetic Heavy chain variable region CDR H2 nucleic acid sequence

SEQ ID NO: 327 - protein, 16 aa, Artificial Sequence
  Description of Artificial Sequence: Synthetic Heavy chain variable region CDR H3 amino acid sequence
VRHGNFGNGYVSWFAH

SEQ ID NO: 328 - DNA, 48 bp, Artificial Sequence; identical to SEQ ID NO: 24
  Description of Artificial Sequence: Synthetic Heavy chain variable region CDR H3 nucleic acid sequence

SEQ ID NO: 329 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagaggatgaagctgattattactgtgtgctgtggtacagtaacctttgggtgttcggcggagggaccaagctgaccgtccta

SEQ ID NO: 330 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQAEDEADYYCVLWYSNLWVFGGGTKLTVL

SEQ ID NO: 331 - protein, 14 aa, Artificial Sequence
  Description of Artificial Sequence: Synthetic Light chain variable region CDR L1 amino acid sequence
GSSTGAVTTSNYAN

SEQ ID NO: 332 - DNA, 42 bp, Artificial Sequence; identical to SEQ ID NO: 204
  Description of Artificial Sequence: Synthetic Light chain variable region CDR L1 nucleic acid sequence

SEQ ID NO: 333 - protein, 7 aa, Artificial Sequence
  Description of Artificial Sequence: Synthetic Light chain variable region CDR L2 amino acid sequence
GTDKRAP

SEQ ID NO: 334 - DNA, 21 bp, Artificial Sequence
  Description of Artificial Sequence: Synthetic Light chain variable region CDR L2 nucleic acid sequence
ggcacagacaagcgcgctcct

SEQ ID NO: 335 - protein, 9 aa, Artificial Sequence
  Description of Artificial Sequence: Synthetic Light chain variable region CDR L3 amino acid sequence
VLWYSNLWV

SEQ ID NO: 336 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 337 - DNA, 375 bp, Artificial Sequence; identical to SEQ ID NO: 17
  Description of Artificial Sequence: Synthetic Heavy chain variable region nucleic acid sequence

SEQ ID NO: 338 - protein, 125 aa, Artificial Sequence; identical to SEQ ID NO: 18
  Description of Artificial Sequence: Synthetic Heavy chain variable region amino acid sequence

SEQ ID NO: 339 - protein, 9 aa, Artificial Sequence
  Description of Artificial Sequence: Synthetic Heavy chain variable region CDR H1 amino acid sequence
FTFDTYAMN

SEQ ID NO: 340 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 341 - protein, 19 aa, Artificial Sequence
  Description of Artificial Sequence: Synthetic Heavy chain variable region CDR H2 amino acid sequence
RIRSKYNNYATYYADSVKD

SEQ ID NO: 342 - DNA, 57 bp, Artificial Sequence; identical to SEQ ID NO: 6
  Description of Artificial Sequence: Synthetic Heavy chain variable region CDR H2 nucleic acid sequence

SEQ ID NO: 343 - protein, 16 aa, Artificial Sequence
  Description of Artificial Sequence: Synthetic Heavy chain variable region CDR H3 amino acid sequence
VRHGNFGNGYVSWFAH

SEQ ID NO: 344 - DNA, 48 bp, Artificial Sequence; identical to SEQ ID NO: 24
  Description of Artificial Sequence: Synthetic Heavy chain variable region CDR H3 nucleic acid sequence

SEQ ID NO: 345 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagaggatgaagctgattattactgtgcgctgtggtacagtaaccattgggtgttcggcggagggaccaagctgaccgtccta

SEQ ID NO: 346 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQAEDEADYYCALWYSNHWVFGGGTKLTVL

SEQ ID NO: 347 - protein, 14 aa, Artificial Sequence
  Description of Artificial Sequence: Synthetic Light chain variable region CDR L1 amino acid sequence
GSSTGAVTTSNYAN

SEQ ID NO: 348 - DNA, 42 bp, Artificial Sequence; identical to SEQ ID NO: 204
  Description of Artificial Sequence: Synthetic Light chain variable region CDR L1 nucleic acid sequence

SEQ ID NO: 349 - protein, 7 aa, Artificial Sequence
  Description of Artificial Sequence: Synthetic Light chain variable region CDR L2 amino acid sequence
GTDKRAP

SEQ ID NO: 350 - DNA, 21 bp, Artificial Sequence
  Description of Artificial Sequence: Synthetic Light chain variable region CDR L2 nucleic acid sequence
ggcacagacaagcgcgctcct

SEQ ID NO: 351 - protein, 9 aa, Artificial Sequence
  Description of Artificial Sequence: Synthetic Light chain variable region CDR L3 amino acid sequence
ALWYSNHWV

SEQ ID NO: 352 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 353 - DNA, 375 bp, Artificial Sequence; identical to SEQ ID NO: 17
  Description of Artificial Sequence: Synthetic Heavy chain variable region nucleic acid sequence

SEQ ID NO: 354 - protein, 125 aa, Artificial Sequence; identical to SEQ ID NO: 18
  Description of Artificial Sequence: Synthetic Heavy chain variable region amino acid sequence

SEQ ID NO: 355 - protein, 9 aa, Artificial Sequence
  Description of Artificial Sequence: Synthetic Heavy chain variable region CDR H1 amino acid sequence
FTFDTYAMN

SEQ ID NO: 356 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 357 - protein, 19 aa, Artificial Sequence
  Description of Artificial Sequence: Synthetic Heavy chain variable region CDR H2 amino acid sequence
RIRSKYNNYATYYADSVKD

SEQ ID NO: 358 - DNA, 57 bp, Artificial Sequence; identical to SEQ ID NO: 6
  Description of Artificial Sequence: Synthetic Heavy chain variable region CDR H2 nucleic acid sequence

SEQ ID NO: 359 - protein, 16 aa, Artificial Sequence
  Description of Artificial Sequence: Synthetic Heavy chain variable region CDR H3 amino acid sequence
VRHGNFGNGYVSWFAH

SEQ ID NO: 360 - DNA, 48 bp, Artificial Sequence; identical to SEQ ID NO: 24
  Description of Artificial Sequence: Synthetic Heavy chain variable region CDR H3 nucleic acid sequence

SEQ ID NO: 361 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcgctggcgcagtcactactagtaactacgccaactgggtccagcagaccccaggccaggctccacgcggactcatcggcggcacagacaagcgcgctcctggggtccctgatcgcttctctggctccctgcttggggacaaagctgccctcatcatcacgggggcccaggcagatgatgaagctgattattactgtgcgctgtggtacagtaacctttgggtgttcggcggagggaccaagctgaccgtccta

SEQ ID NO: 362 - protein, 109 aa, Artificial Sequence
  Description of Artificial Sequence: Synthetic Light chain variable region amino acid sequence
QTVVTQEPSLSVSPGGTVTLTCGSSAGAVTTSNYANWVQQTPGQAPRGLIGGTDKRAPGVPDRFSGSLLGDKAALIITGAQADDEADYYCALWYSNLWVFGGGTKLTVL

SEQ ID NO: 363 - protein, 14 aa, Artificial Sequence
  Description of Artificial Sequence: Synthetic Light chain variable region CDR L1 amino acid sequence
GSSAGAVTTSNYAN

SEQ ID NO: 364 - DNA, 42 bp, Artificial Sequence; identical to SEQ ID NO: 236
  Description of Artificial Sequence: Synthetic Light chain variable region CDR L1 nucleic acid sequence

SEQ ID NO: 365 - protein, 7 aa, Artificial Sequence
  Description of Artificial Sequence: Synthetic Light chain variable region CDR L2 amino acid sequence
GTDKRAP

SEQ ID NO: 366 - DNA, 21 bp, Artificial Sequence
  Description of Artificial Sequence: Synthetic Light chain variable region CDR L2 nucleic acid sequence
ggcacagacaagcgcgctcct

SEQ ID NO: 367 - protein, 9 aa, Artificial Sequence
  Description of Artificial Sequence: Synthetic Light chain variable region CDR L3 amino acid sequence
ALWYSNLWV

SEQ ID NO: 368 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 369 - DNA, 375 bp, Artificial Sequence; identical to SEQ ID NO: 17
  Description of Artificial Sequence: Synthetic Heavy chain variable region nucleic acid sequence

SEQ ID NO: 370 - protein, 125 aa, Artificial Sequence; identical to SEQ ID NO: 18
  Description of Artificial Sequence: Synthetic Heavy chain variable region amino acid sequence

SEQ ID NO: 371 - protein, 9 aa, Artificial Sequence
  Description of Artificial Sequence: Synthetic Heavy chain variable region CDR H1 amino acid sequence
FTFDTYAMN

SEQ ID NO: 372 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 373 - protein, 19 aa, Artificial Sequence
  Description of Artificial Sequence: Synthetic Heavy chain variable region CDR H2 amino acid sequence
RIRSKYNNYATYYADSVKD

SEQ ID NO: 374 - DNA, 57 bp, Artificial Sequence; identical to SEQ ID NO: 6
  Description of Artificial Sequence: Synthetic Heavy chain variable region CDR H2 nucleic acid sequence

SEQ ID NO: 375 - protein, 16 aa, Artificial Sequence
  Description of Artificial Sequence: Synthetic Heavy chain variable region CDR H3 amino acid sequence
VRHGNFGNGYVSWFAH

SEQ ID NO: 376 - DNA, 48 bp, Artificial Sequence; identical to SEQ ID NO: 24
  Description of Artificial Sequence: Synthetic Heavy chain variable region CDR H3 nucleic acid sequence

SEQ ID NO: 377 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcgctggcgcagtcactactagtaactacgccaactgggtccagcagaccccaggccaggctccacgcggactcatcggcggcacagacaagcgcgctcctggggtccctgatcgcttctctggctccctgcttggggacaaagctgccctcaccatcacgggggcccaggcagatgatgaagctgattattactgtgcgctgtggtacaataacctttgggtgttcggcggagggaccaagctgaccgtccta

SEQ ID NO: 378 - protein, 109 aa, Artificial Sequence
  Description of Artificial Sequence: Synthetic Light chain variable region amino acid sequence
QTVVTQEPSLSVSPGGTVTLTCGSSAGAVTTSNYANWVQQTPGQAPRGLIGGTDKRAPGVPDRFSGSLLGDKAALTITGAQADDEADYYCALWYNNLWVFGGGTKLTVL

SEQ ID NO: 379 - protein, 14 aa, Artificial Sequence
  Description of Artificial Sequence: Synthetic Light chain variable region CDR L1 amino acid sequence
GSSAGAVTTSNYAN

SEQ ID NO: 380 - DNA, 42 bp, Artificial Sequence; identical to SEQ ID NO: 236
  Description of Artificial Sequence: Synthetic Light chain variable region CDR L1 nucleic acid sequence

SEQ ID NO: 381 - protein, 7 aa, Artificial Sequence
  Description of Artificial Sequence: Synthetic Light chain variable region CDR L2 amino acid sequence
GTDKRAP

SEQ ID NO: 382 - DNA, 21 bp, Artificial Sequence
  Description of Artificial Sequence: Synthetic Light chain variable region CDR L2 nucleic acid sequence
ggcacagacaagcgcgctcct

SEQ ID NO: 383 - protein, 9 aa, Artificial Sequence
  Description of Artificial Sequence: Synthetic Light chain variable region CDR L3 amino acid sequence
ALWYNNLWV

SEQ ID NO: 384 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 385 - DNA, 375 bp, Artificial Sequence; identical to SEQ ID NO: 145
  Description of Artificial Sequence: Synthetic Heavy chain variable region nucleic acid sequence

SEQ ID NO: 386 - protein, 125 aa, Artificial Sequence; identical to SEQ ID NO: 146
  Description of Artificial Sequence: Synthetic Heavy chain variable region amino acid sequence

SEQ ID NO: 387 - protein, 9 aa, Artificial Sequence
  Description of Artificial Sequence: Synthetic Heavy chain variable region CDR H1 amino acid sequence
FTFDTYAMN

SEQ ID NO: 388 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 389 - protein, 19 aa, Artificial Sequence
  Description of Artificial Sequence: Synthetic Heavy chain variable region CDR H2 amino acid sequence
RIRSKYNNYATYYADSVKD

SEQ ID NO: 390 - DNA, 57 bp, Artificial Sequence; identical to SEQ ID NO: 6
  Description of Artificial Sequence: Synthetic Heavy chain variable region CDR H2 nucleic acid sequence

SEQ ID NO: 391 - protein, 16 aa, Artificial Sequence
  Description of Artificial Sequence: Synthetic Heavy chain variable region CDR H3 amino acid sequence
VRHSNFGNSYVSWFAH

SEQ ID NO: 392 - DNA, 48 bp, Artificial Sequence; identical to SEQ ID NO: 152
  Description of Artificial Sequence: Synthetic Heavy chain variable region CDR H3 nucleic acid sequence

SEQ ID NO: 393 - DNA, 327 bp, Artificial Sequence; identical to SEQ ID NO: 361
  Description of Artificial Sequence: Synthetic Light chain variable region nucleic acid sequence

SEQ ID NO: 394 - protein, 109 aa, Artificial Sequence; identical to SEQ ID NO: 362
  Description of Artificial Sequence: Synthetic Light chain variable region amino acid sequence

SEQ ID NO: 395 - protein, 14 aa, Artificial Sequence
  Description of Artificial Sequence: Synthetic Light chain variable region CDR L1 amino acid sequence
GSSAGAVTTSNYAN

SEQ ID NO: 396 - DNA, 42 bp, Artificial Sequence; identical to SEQ ID NO: 236
  Description of Artificial Sequence: Synthetic Light chain variable region CDR L1 nucleic acid sequence

SEQ ID NO: 397 - protein, 7 aa, Artificial Sequence
  Description of Artificial Sequence: Synthetic Light chain variable region CDR L2 amino acid sequence
GTDKRAP

SEQ ID NO: 398 - DNA, 21 bp, Artificial Sequence
  Description of Artificial Sequence: Synthetic Light chain variable region CDR L2 nucleic acid sequence
ggcacagacaagcgcgctcct

SEQ ID NO: 399 - protein, 9 aa, Artificial Sequence
  Description of Artificial Sequence: Synthetic Light chain variable region CDR L3 amino acid sequence
ALWYSNLWV

SEQ ID NO: 400 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 401 - DNA, 375 bp, Artificial Sequence; identical to SEQ ID NO: 145
  Description of Artificial Sequence: Synthetic Heavy chain variable region nucleic acid sequence

SEQ ID NO: 402 - protein, 125 aa, Artificial Sequence; identical to SEQ ID NO: 146
  Description of Artificial Sequence: Synthetic Heavy chain variable region amino acid sequence

SEQ ID NO: 403 - protein, 9 aa, Artificial Sequence
  Description of Artificial Sequence: Synthetic Heavy chain variable region CDR H1 amino acid sequence
FTFDTYAMN

SEQ ID NO: 404 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 405 - protein, 19 aa, Artificial Sequence
  Description of Artificial Sequence: Synthetic Heavy chain variable region CDR H2 amino acid sequence
RIRSKYNNYATYYADSVKD

SEQ ID NO: 406 - DNA, 57 bp, Artificial Sequence; identical to SEQ ID NO: 6
  Description of Artificial Sequence: Synthetic Heavy chain variable region CDR H2 nucleic acid sequence

SEQ ID NO: 407 - protein, 16 aa, Artificial Sequence
  Description of Artificial Sequence: Synthetic Heavy chain variable region CDR H3 amino acid sequence
VRHSNFGNSYVSWFAH

SEQ ID NO: 408 - DNA, 48 bp, Artificial Sequence; identical to SEQ ID NO: 152
  Description of Artificial Sequence: Synthetic Heavy chain variable region CDR H3 nucleic acid sequence

SEQ ID NO: 409 - DNA, 327 bp, Artificial Sequence; identical to SEQ ID NO: 377
  Description of Artificial Sequence: Synthetic Light chain variable region nucleic acid sequence

SEQ ID NO: 410 - protein, 109 aa, Artificial Sequence; identical to SEQ ID NO: 378
  Description of Artificial Sequence: Synthetic Light chain variable region amino acid sequence

SEQ ID NO: 411 - protein, 14 aa, Artificial Sequence
  Description of Artificial Sequence: Synthetic Light chain variable region CDR L1 amino acid sequence
GSSAGAVTTSNYAN

SEQ ID NO: 412 - DNA, 42 bp, Artificial Sequence; identical to SEQ ID NO: 236
  Description of Artificial Sequence: Synthetic Light chain variable region CDR L1 nucleic acid sequence

SEQ ID NO: 413 - protein, 7 aa, Artificial Sequence
  Description of Artificial Sequence: Synthetic Light chain variable region CDR L2 amino acid sequence
GTDKRAP

SEQ ID NO: 414 - DNA, 21 bp, Artificial Sequence
  Description of Artificial Sequence: Synthetic Light chain variable region CDR L2 nucleic acid sequence
ggcacagacaagcgcgctcct

SEQ ID NO: 415 - protein, 9 aa, Artificial Sequence
  Description of Artificial Sequence: Synthetic Light chain variable region CDR L3 amino acid sequence
ALWYNNLWV

SEQ ID NO: 416 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 417 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacgcttatgccatgaattgggttcgccaggctccagggaaggggctggagtgggtcgcaaggattagatccaagtataacgattacgctacatactacgcagactccgtgaaggatcggttcaccatctccagagacgattccaagagcacgctgtatctgcaaatgaacagcctgagagccgaggacacggcggtgtactactgcgtcaggcacggtaacttcgggaacggttacgtatcctggtttgctcattggggccaaggaaccctggtcaccgtctcctca

SEQ ID NO: 418 - protein, 125 aa, Artificial Sequence
  Description of Artificial Sequence: Synthetic Heavy chain variable region amino acid sequence
EVQLLESGGGLVQPGGSLRLSCAASGFTFDAYAMNWVRQAPGKGLEWVARIRSKYNDYATYYADSVKDRFTISRDDSKSTLYLQMNSLRAEDTAVYYCVRHGNFGNGYVSWFAHWGQGTLVTVSS

SEQ ID NO: 419 - protein, 9 aa, Artificial Sequence
  Description of Artificial Sequence: Synthetic Heavy chain variable region CDR H1 amino acid sequence
FTFDAYAMN

SEQ ID NO: 420 - DNA, 27 bp, Artificial Sequence
  Description of Artificial Sequence: Synthetic Heavy chain variable region CDR H1 nucleic acid sequence
ttcacctttgacgcttatgccatgaat

SEQ ID NO: 421 - protein, 19 aa, Artificial Sequence
  Description of Artificial Sequence: Synthetic Heavy chain variable region CDR H2 amino acid sequence
RIRSKYNDYATYYADSVKD

SEQ ID NO: 422 - DNA, 57 bp, Artificial Sequence
  Description of Artificial Sequence: Synthetic Heavy chain variable region CDR H2 nucleic acid sequence
aggattagatccaagtataacgattacgctacatactacgcagactccgtgaaggat

SEQ ID NO: 423 - protein, 16 aa, Artificial Sequence
  Description of Artificial Sequence: Synthetic Heavy chain variable region CDR H3 amino acid sequence
VRHGNFGNGYVSWFAH

SEQ ID NO: 424 - DNA, 48 bp, Artificial Sequence; identical to SEQ ID NO: 24
  Description of Artificial Sequence: Synthetic Heavy chain variable region CDR H3 nucleic acid sequence

SEQ ID NO: 425 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagaggatgaagctgattattactgtgcgctgtggtacagtgatctgtgggtgttcggcggagggaccaagctgaccgtccta

SEQ ID NO: 426 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQAEDEADYYCALWYSDLWVFGGGTKLTVL

SEQ ID NO: 427 - protein, 14 aa, Artificial Sequence
  Description of Artificial Sequence: Synthetic Light chain variable region CDR L1 amino acid sequence
GSSTGAVTTSNYAN

SEQ ID NO: 428 - DNA, 42 bp, Artificial Sequence; identical to SEQ ID NO: 204
  Description of Artificial Sequence: Synthetic Light chain variable region CDR L1 nucleic acid sequence

SEQ ID NO: 429 - protein, 7 aa, Artificial Sequence
  Description of Artificial Sequence: Synthetic Light chain variable region CDR L2 amino acid sequence
GTDKRAP

SEQ ID NO: 430 - DNA, 21 bp, Artificial Sequence
  Description of Artificial Sequence: Synthetic Light chain variable region CDR L2 nucleic acid sequence
ggcacagacaagcgcgctcct

SEQ ID NO: 431 - protein, 9 aa, Artificial Sequence
  Description of Artificial Sequence: Synthetic Light chain variable region CDR L3 amino acid sequence
ALWYSDLWV

SEQ ID NO: 432 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 433 - DNA, 375 bp, Artificial Sequence; identical to SEQ ID NO: 17
  Description of Artificial Sequence: Synthetic Heavy chain variable region nucleic acid sequence

SEQ ID NO: 434 - protein, 125 aa, Artificial Sequence; identical to SEQ ID NO: 18
  Description of Artificial Sequence: Synthetic Heavy chain variable region amino acid sequence

SEQ ID NO: 435 - protein, 9 aa, Artificial Sequence
  Description of Artificial Sequence: Synthetic Heavy chain variable region CDR H1 amino acid sequence
FTFDTYAMN

SEQ ID NO: 436 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 437 - protein, 19 aa, Artificial Sequence
  Description of Artificial Sequence: Synthetic Heavy chain variable region CDR H2 amino acid sequence
RIRSKYNNYATYYADSVKD

SEQ ID NO: 438 - DNA, 57 bp, Artificial Sequence; identical to SEQ ID NO: 6
  Description of Artificial Sequence: Synthetic Heavy chain variable region CDR H2 nucleic acid sequence

SEQ ID NO: 439 - protein, 16 aa, Artificial Sequence
  Description of Artificial Sequence: Synthetic Heavy chain variable region CDR H3 amino acid sequence
VRHGNFGNGYVSWFAH

SEQ ID NO: 440 - DNA, 48 bp, Artificial Sequence; identical to SEQ ID NO: 24
  Description of Artificial Sequence: Synthetic Heavy chain variable region CDR H3 nucleic acid sequence

SEQ ID NO: 441 - DNA, 327 bp, Artificial Sequence; identical to SEQ ID NO: 425
  Description of Artificial Sequence: Synthetic Light chain variable region nucleic acid sequence

SEQ ID NO: 442 - protein, 109 aa, Artificial Sequence; identical to SEQ ID NO: 426
  Description of Artificial Sequence: Synthetic Light chain variable region amino acid sequence

SEQ ID NO: 443 - protein, 14 aa, Artificial Sequence
  Description of Artificial Sequence: Synthetic Light chain variable region CDR L1 amino acid sequence
GSSTGAVTTSNYAN

SEQ ID NO: 444 - DNA, 42 bp, Artificial Sequence; identical to SEQ ID NO: 204
  Description of Artificial Sequence: Synthetic Light chain variable region CDR L1 nucleic acid sequence

SEQ ID NO: 445 - protein, 7 aa, Artificial Sequence
  Description of Artificial Sequence: Synthetic Light chain variable region CDR L2 amino acid sequence
GTDKRAP

SEQ ID NO: 446 - DNA, 21 bp, Artificial Sequence
  Description of Artificial Sequence: Synthetic Light chain variable region CDR L2 nucleic acid sequence
ggcacagacaagcgcgctcct

SEQ ID NO: 447 - protein, 9 aa, Artificial Sequence
  Description of Artificial Sequence: Synthetic Light chain variable region CDR L3 amino acid sequence
ALWYSDLWV

SEQ ID NO: 448 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 449 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttcgggaacggttacgtatcctggtttgctcattggggccaaggaaccctggtcaccgtctcctca

SEQ ID NO: 450 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHGNFGNGYVSWFAHWGQGTLVTVSS

SEQ ID NO: 451 - protein, 9 aa, Artificial Sequence
  Description of Artificial Sequence: Synthetic Heavy chain variable region CDR H1 amino acid sequence
FTFDTYAMN

SEQ ID NO: 452 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 453 - protein, 19 aa, Artificial Sequence
  Description of Artificial Sequence: Synthetic Heavy chain variable region CDR H2 amino acid sequence
RIRSKYNNYATYYADSVKD

SEQ ID NO: 454 - DNA, 57 bp, Artificial Sequence; identical to SEQ ID NO: 6
  Description of Artificial Sequence: Synthetic Heavy chain variable region CDR H2 nucleic acid sequence

SEQ ID NO: 455 - protein, 16 aa, Artificial Sequence
  Description of Artificial Sequence: Synthetic Heavy chain variable region CDR H3 amino acid sequence
VRHGNFGNGYVSWFAH

SEQ ID NO: 456 - DNA, 48 bp, Artificial Sequence; identical to SEQ ID NO: 24
  Description of Artificial Sequence: Synthetic Heavy chain variable region CDR H3 nucleic acid sequence

SEQ ID NO: 457 - DNA, 327 bp, Artificial Sequence; identical to SEQ ID NO: 345
  Description of Artificial Sequence: Synthetic Light chain variable region nucleic acid sequence

SEQ ID NO: 458 - protein, 109 aa, Artificial Sequence; identical to SEQ ID NO: 346
  Description of Artificial Sequence: Synthetic Light chain variable region amino acid sequence

SEQ ID NO: 459 - protein, 14 aa, Artificial Sequence
  Description of Artificial Sequence: Synthetic Light chain variable region CDR L1 amino acid sequence
GSSTGAVTTSNYAN

SEQ ID NO: 460 - DNA, 42 bp, Artificial Sequence; identical to SEQ ID NO: 204
  Description of Artificial Sequence: Synthetic Light chain variable region CDR L1 nucleic acid sequence

SEQ ID NO: 461 - protein, 7 aa, Artificial Sequence
  Description of Artificial Sequence: Synthetic Light chain variable region CDR L2 amino acid sequence
GTDKRAP

SEQ ID NO: 462 - DNA, 21 bp, Artificial Sequence
  Description of Artificial Sequence: Synthetic Light chain variable region CDR L2 nucleic acid sequence
ggcacagacaagcgcgctcct

SEQ ID NO: 463 - protein, 9 aa, Artificial Sequence
  Description of Artificial Sequence: Synthetic Light chain variable region CDR L3 amino acid sequence
ALWYSNHWV

SEQ ID NO: 464 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 465 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatgaacagcctgagagccgaggacacggcggtgtactactgcgtcaggcacggtaacttcggggaaggttacgtatcctggtttgctcattggggccaaggaaccctggtcaccgtctcctca

SEQ ID NO: 466 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMNSLRAEDTAVYYCVRHGNFGEGYVSWFAHWGQGTLVTVSS

SEQ ID NO: 467 - protein, 9 aa, Artificial Sequence
  Description of Artificial Sequence: Synthetic Heavy chain variable region CDR H1 amino acid sequence
FTFDTYAMN

SEQ ID NO: 468 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 469 - protein, 19 aa, Artificial Sequence
  Description of Artificial Sequence: Synthetic Heavy chain variable region CDR H2 amino acid sequence
RIRSKYNNYATYYADSVKD

SEQ ID NO: 470 - DNA, 57 bp, Artificial Sequence; identical to SEQ ID NO: 6
  Description of Artificial Sequence: Synthetic Heavy chain variable region CDR H2 nucleic acid sequence

SEQ ID NO: 471 - protein, 16 aa, Artificial Sequence
  Description of Artificial Sequence: Synthetic Heavy chain variable region CDR H3 amino acid sequence
VRHGNFGEGYVSWFAH

SEQ ID NO: 472 - DNA, 48 bp, Artificial Sequence
  Description of Artificial Sequence: Synthetic Heavy chain variable region CDR H3 nucleic acid sequence
gtcaggcacggtaacttcggggaaggttacgtatcctggtttgctcat

SEQ ID NO: 473 - DNA, 327 bp, Artificial Sequence; identical to SEQ ID NO: 345
  Description of Artificial Sequence: Synthetic Light chain variable region nucleic acid sequence

SEQ ID NO: 474 - protein, 109 aa, Artificial Sequence; identical to SEQ ID NO: 346
  Description of Artificial Sequence: Synthetic Light chain variable region amino acid sequence

SEQ ID NO: 475 - protein, 14 aa, Artificial Sequence
  Description of Artificial Sequence: Synthetic Light chain variable region CDR L1 amino acid sequence
GSSTGAVTTSNYAN

SEQ ID NO: 476 - DNA, 42 bp, Artificial Sequence; identical to SEQ ID NO: 204
  Description of Artificial Sequence: Synthetic Light chain variable region CDR L1 nucleic acid sequence

SEQ ID NO: 477 - protein, 7 aa, Artificial Sequence
  Description of Artificial Sequence: Synthetic Light chain variable region CDR L2 amino acid sequence
GTDKRAP

SEQ ID NO: 478 - DNA, 21 bp, Artificial Sequence
  Description of Artificial Sequence: Synthetic Light chain variable region CDR L2 nucleic acid sequence
ggcacagacaagcgcgctcct

SEQ ID NO: 479 - protein, 9 aa, Artificial Sequence
  Description of Artificial Sequence: Synthetic Light chain variable region CDR L3 amino acid sequence
ALWYSNHWV

SEQ ID NO: 480 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 481 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttcggggaaggttacgtatcctggtttgctcattggggccaaggaaccctggtcaccgtctcctca

SEQ ID NO: 482 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHGNFGEGYVSWFAHWGQGTLVTVSS

SEQ ID NO: 483 - protein, 9 aa, Artificial Sequence
  Description of Artificial Sequence: Synthetic Heavy chain variable region CDR H1 amino acid sequence
FTFDTYAMN

SEQ ID NO: 484 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 485 - protein, 19 aa, Artificial Sequence
  Description of Artificial Sequence: Synthetic Heavy chain variable region CDR H2 amino acid sequence
RIRSKYNNYATYYADSVKD

SEQ ID NO: 486 - DNA, 57 bp, Artificial Sequence; identical to SEQ ID NO: 6
  Description of Artificial Sequence: Synthetic Heavy chain variable region CDR H2 nucleic acid sequence

SEQ ID NO: 487 - protein, 16 aa, Artificial Sequence
  Description of Artificial Sequence: Synthetic Heavy chain variable region CDR H3 amino acid sequence
VRHGNFGEGYVSWFAH

SEQ ID NO: 488 - DNA, 48 bp, Artificial Sequence; identical to SEQ ID NO: 472
  Description of Artificial Sequence: Synthetic Heavy chain variable region CDR H3 nucleic acid sequence

SEQ ID NO: 489 - DNA, 327 bp, Artificial Sequence; identical to SEQ ID NO: 345
  Description of Artificial Sequence: Synthetic Light chain variable region nucleic acid sequence

SEQ ID NO: 490 - protein, 109 aa, Artificial Sequence; identical to SEQ ID NO: 346
  Description of Artificial Sequence: Synthetic Light chain variable region amino acid sequence

SEQ ID NO: 491 - protein, 14 aa, Artificial Sequence
  Description of Artificial Sequence: Synthetic Light chain variable region CDR L1 amino acid sequence
GSSTGAVTTSNYAN

SEQ ID NO: 492 - DNA, 42 bp, Artificial Sequence; identical to SEQ ID NO: 204
  Description of Artificial Sequence: Synthetic Light chain variable region CDR L1 nucleic acid sequence

SEQ ID NO: 493 - protein, 7 aa, Artificial Sequence
  Description of Artificial Sequence: Synthetic Light chain variable region CDR L2 amino acid sequence
GTDKRAP

SEQ ID NO: 494 - DNA, 21 bp, Artificial Sequence
  Description of Artificial Sequence: Synthetic Light chain variable region CDR L2 nucleic acid sequence
ggcacagacaagcgcgctcct

SEQ ID NO: 495 - protein, 9 aa, Artificial Sequence
  Description of Artificial Sequence: Synthetic Light chain variable region CDR L3 amino acid sequence
ALWYSNHWV

SEQ ID NO: 496 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 497 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatgaacgctctgagagccgaggacacggcggtgtactactgcgtcaggcacggtaacttcgggaacggttacgtatcctggtttgctcattggggccaaggaaccctggtcaccgtctcctca

SEQ ID NO: 498 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMNALRAEDTAVYYCVRHGNFGNGYVSWFAHWGQGTLVTVSS

SEQ ID NO: 499 - protein, 9 aa, Artificial Sequence
  Description of Artificial Sequence: Synthetic Heavy chain variable region CDR H1 amino acid sequence
FTFDTYAMN

SEQ ID NO: 500 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 501 - protein, 19 aa, Artificial Sequence
  Description of Artificial Sequence: Synthetic Heavy chain variable region CDR H2 amino acid sequence
RIRSKYNNYATYYADSVKD

SEQ ID NO: 502 - DNA, 57 bp, Artificial Sequence; identical to SEQ ID NO: 6
  Description of Artificial Sequence: Synthetic Heavy chain variable region CDR H2 nucleic acid sequence

SEQ ID NO: 503 - protein, 16 aa, Artificial Sequence
  Description of Artificial Sequence: Synthetic Heavy chain variable region CDR H3 amino acid sequence
VRHGNFGNGYVSWFAH

SEQ ID NO: 504 - DNA, 48 bp, Artificial Sequence; identical to SEQ ID NO: 24
  Description of Artificial Sequence: Synthetic Heavy chain variable region CDR H3 nucleic acid sequence

SEQ ID NO: 505 - DNA, 327 bp, Artificial Sequence; identical to SEQ ID NO: 345
  Description of Artificial Sequence: Synthetic Light chain variable region nucleic acid sequence

SEQ ID NO: 506 - protein, 109 aa, Artificial Sequence; identical to SEQ ID NO: 346
  Description of Artificial Sequence: Synthetic Light chain variable region amino acid sequence

SEQ ID NO: 507 - protein, 14 aa, Artificial Sequence
  Description of Artificial Sequence: Synthetic Light chain variable region CDR L1 amino acid sequence
GSSTGAVTTSNYAN

SEQ ID NO: 508 - DNA, 42 bp, Artificial Sequence; identical to SEQ ID NO: 204
  Description of Artificial Sequence: Synthetic Light chain variable region CDR L1 nucleic acid sequence

SEQ ID NO: 509 - protein, 7 aa, Artificial Sequence
  Description of Artificial Sequence: Synthetic Light chain variable region CDR L2 amino acid sequence
GTDKRAP

SEQ ID NO: 510 - DNA, 21 bp, Artificial Sequence
  Description of Artificial Sequence: Synthetic Light chain variable region CDR L2 nucleic acid sequence
ggcacagacaagcgcgctcct

SEQ ID NO: 511 - protein, 9 aa, Artificial Sequence
  Description of Artificial Sequence: Synthetic Light chain variable region CDR L3 amino acid sequence
ALWYSNHWV

SEQ ID NO: 512 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 513 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatgaacagcctgagagccgaggacacggcggtgtactactgcgtcaggcacggtaacttcgggaacgcttacgtatcctggtttgctcattggggccaaggaaccctggtcaccgtctcctca

SEQ ID NO: 514 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMNSLRAEDTAVYYCVRHGNFGNAYVSWFAHWGQGTLVTVSS

SEQ ID NO: 515 - protein, 9 aa, Artificial Sequence
  Description of Artificial Sequence: Synthetic Heavy chain variable region CDR H1 amino acid sequence
FTFDTYAMN

SEQ ID NO: 516 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 517 - protein, 19 aa, Artificial Sequence
  Description of Artificial Sequence: Synthetic Heavy chain variable region CDR H2 amino acid sequence
RIRSKYNNYATYYADSVKD

SEQ ID NO: 518 - DNA, 57 bp, Artificial Sequence; identical to SEQ ID NO: 6
  Description of Artificial Sequence: Synthetic Heavy chain variable region CDR H2 nucleic acid sequence

SEQ ID NO: 519 - protein, 16 aa, Artificial Sequence
  Description of Artificial Sequence: Synthetic Heavy chain variable region CDR H3 amino acid sequence
VRHGNFGNAYVSWFAH

SEQ ID NO: 520 - DNA, 48 bp, Artificial Sequence
  Description of Artificial Sequence: Synthetic Heavy chain variable region CDR H3 nucleic acid sequence
gtcaggcacggtaacttcgggaacgcttacgtatcctggtttgctcat

SEQ ID NO: 521 - DNA, 327 bp, Artificial Sequence; identical to SEQ ID NO: 345
  Description of Artificial Sequence: Synthetic Light chain variable region nucleic acid sequence

SEQ ID NO: 522 - protein, 109 aa, Artificial Sequence; identical to SEQ ID NO: 346
  Description of Artificial Sequence: Synthetic Light chain variable region amino acid sequence

SEQ ID NO: 523 - protein, 14 aa, Artificial Sequence
  Description of Artificial Sequence: Synthetic Light chain variable region CDR L1 amino acid sequence
GSSTGAVTTSNYAN

SEQ ID NO: 524 - DNA, 42 bp, Artificial Sequence; identical to SEQ ID NO: 204
  Description of Artificial Sequence: Synthetic Light chain variable region CDR L1 nucleic acid sequence

SEQ ID NO: 525 - protein, 7 aa, Artificial Sequence
  Description of Artificial Sequence: Synthetic Light chain variable region CDR L2 amino acid sequence
GTDKRAP

SEQ ID NO: 526 - DNA, 21 bp, Artificial Sequence
  Description of Artificial Sequence: Synthetic Light chain variable region CDR L2 nucleic acid sequence
ggcacagacaagcgcgctcct

SEQ ID NO: 527 - protein, 9 aa, Artificial Sequence
  Description of Artificial Sequence: Synthetic Light chain variable region CDR L3 amino acid sequence
ALWYSNHWV

SEQ ID NO: 528 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 529 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatgaacgctctgagagccgaggacacggcggtgtactactgcgtcaggcacggtaacttcgggaacgcttacgtatcctggtttgctcattggggccaaggaaccctggtcaccgtctcctca

SEQ ID NO: 530 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMNALRAEDTAVYYCVRHGNFGNAYVSWFAHWGQGTLVTVSS

SEQ ID NO: 531 - protein, 9 aa, Artificial Sequence
  Description of Artificial Sequence: Synthetic Heavy chain variable region CDR H1 amino acid sequence
FTFDTYAMN

SEQ ID NO: 532 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 533 - protein, 19 aa, Artificial Sequence
  Description of Artificial Sequence: Synthetic Heavy chain variable region CDR H2 amino acid sequence
RIRSKYNNYATYYADSVKD

SEQ ID NO: 534 - DNA, 57 bp, Artificial Sequence; identical to SEQ ID NO: 6
  Description of Artificial Sequence: Synthetic Heavy chain variable region CDR H2 nucleic acid sequence

SEQ ID NO: 535 - protein, 16 aa, Artificial Sequence
  Description of Artificial Sequence: Synthetic Heavy chain variable region CDR H3 amino acid sequence
VRHGNFGNAYVSWFAH

SEQ ID NO: 536 - DNA, 48 bp, Artificial Sequence; identical to SEQ ID NO: 520
  Description of Artificial Sequence: Synthetic Heavy chain variable region CDR H3 nucleic acid sequence

SEQ ID NO: 537 - DNA, 327 bp, Artificial Sequence; identical to SEQ ID NO: 345
  Description of Artificial Sequence: Synthetic Light chain variable region nucleic acid sequence

SEQ ID NO: 538 - protein, 109 aa, Artificial Sequence; identical to SEQ ID NO: 346
  Description of Artificial Sequence: Synthetic Light chain variable region amino acid sequence

SEQ ID NO: 539 - protein, 14 aa, Artificial Sequence
  Description of Artificial Sequence: Synthetic Light chain variable region CDR L1 amino acid sequence
GSSTGAVTTSNYAN

SEQ ID NO: 540 - DNA, 42 bp, Artificial Sequence; identical to SEQ ID NO: 204
  Description of Artificial Sequence: Synthetic Light chain variable region CDR L1 nucleic acid sequence

SEQ ID NO: 541 - protein, 7 aa, Artificial Sequence
  Description of Artificial Sequence: Synthetic Light chain variable region CDR L2 amino acid sequence
GTDKRAP

SEQ ID NO: 542 - DNA, 21 bp, Artificial Sequence
  Description of Artificial Sequence: Synthetic Light chain variable region CDR L2 nucleic acid sequence
ggcacagacaagcgcgctcct

SEQ ID NO: 543 - protein, 9 aa, Artificial Sequence
  Description of Artificial Sequence: Synthetic Light chain variable region CDR L3 amino acid sequence
ALWYSNHWV

SEQ ID NO: 544 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 545 - DNA, 375 bp, Artificial Sequence; identical to SEQ ID NO: 17
  Description of Artificial Sequence: Synthetic Heavy chain variable region nucleic acid sequence

SEQ ID NO: 546 - protein, 125 aa, Artificial Sequence; identical to SEQ ID NO: 18
  Description of Artificial Sequence: Synthetic Heavy chain variable region amino acid sequence

SEQ ID NO: 547 - protein, 9 aa, Artificial Sequence
  Description of Artificial Sequence: Synthetic Heavy chain variable region CDR H1 amino acid sequence
FTFDTYAMN

SEQ ID NO: 548 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 549 - protein, 19 aa, Artificial Sequence
  Description of Artificial Sequence: Synthetic Heavy chain variable region CDR H2 amino acid sequence
RIRSKYNNYATYYADSVKD

SEQ ID NO: 550 - DNA, 57 bp, Artificial Sequence; identical to SEQ ID NO: 6
  Description of Artificial Sequence: Synthetic Heavy chain variable region CDR H2 nucleic acid sequence

SEQ ID NO: 551 - protein, 16 aa, Artificial Sequence
  Description of Artificial Sequence: Synthetic Heavy chain variable region CDR H3 amino acid sequence
VRHGNFGNGYVSWFAH

SEQ ID NO: 552 - DNA, 48 bp, Artificial Sequence; identical to SEQ ID NO: 24
  Description of Artificial Sequence: Synthetic Heavy chain variable region CDR H3 nucleic acid sequence

SEQ ID NO: 553 - DNA, 327 bp, Artificial Sequence; identical to SEQ ID NO: 345
  Description of Artificial Sequence: Synthetic Light chain variable region nucleic acid sequence

SEQ ID NO: 554 - protein, 109 aa, Artificial Sequence; identical to SEQ ID NO: 346
  Description of Artificial Sequence: Synthetic Light chain variable region amino acid sequence

SEQ ID NO: 555 - protein, 14 aa, Artificial Sequence
  Description of Artificial Sequence: Synthetic Light chain variable region CDR L1 amino acid sequence
GSSTGAVTTSNYAN

SEQ ID NO: 556 - DNA, 42 bp, Artificial Sequence; identical to SEQ ID NO: 204
  Description of Artificial Sequence: Synthetic Light chain variable region CDR L1 nucleic acid sequence

SEQ ID NO: 557 - protein, 7 aa, Artificial Sequence
  Description of Artificial Sequence: Synthetic Light chain variable region CDR L2 amino acid sequence
GTDKRAP

SEQ ID NO: 558 - DNA, 21 bp, Artificial Sequence
  Description of Artificial Sequence: Synthetic Light chain variable region CDR L2 nucleic acid sequence
ggcacagacaagcgcgctcct

SEQ ID NO: 559 - protein, 9 aa, Artificial Sequence
  Description of Artificial Sequence: Synthetic Light chain variable region CDR L3 amino acid sequence
ALWYSNHWV

SEQ ID NO: 560 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 561 - DNA, 375 bp, Artificial Sequence; identical to SEQ ID NO: 17
  Description of Artificial Sequence: Synthetic Heavy chain variable region nucleic acid sequence

SEQ ID NO: 562 - protein, 125 aa, Artificial Sequence; identical to SEQ ID NO: 18
  Description of Artificial Sequence: Synthetic Heavy chain variable region amino acid sequence

SEQ ID NO: 563 - protein, 9 aa, Artificial Sequence
  Description of Artificial Sequence: Synthetic Heavy chain variable region CDR H1 amino acid sequence
FTFDTYAMN

SEQ ID NO: 564 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 565 - protein, 19 aa, Artificial Sequence
  Description of Artificial Sequence: Synthetic Heavy chain variable region CDR H2 amino acid sequence
RIRSKYNNYATYYADSVKD

SEQ ID NO: 566 - DNA, 57 bp, Artificial Sequence; identical to SEQ ID NO: 6
  Description of Artificial Sequence: Synthetic Heavy chain variable region CDR H2 nucleic acid sequence

SEQ ID NO: 567 - protein, 16 aa, Artificial Sequence
  Description of Artificial Sequence: Synthetic Heavy chain variable region CDR H3 amino acid sequence
VRHGNFGNGYVSWFAH

SEQ ID NO: 568 - DNA, 48 bp, Artificial Sequence; identical to SEQ ID NO: 24
  Description of Artificial Sequence: Synthetic Heavy chain variable region CDR H3 nucleic acid sequence

SEQ ID NO: 569 - DNA, 327 bp, Artificial Sequence; identical to SEQ ID NO: 345
  Description of Artificial Sequence: Synthetic Light chain variable region nucleic acid sequence

SEQ ID NO: 570 - protein, 109 aa, Artificial Sequence; identical to SEQ ID NO: 346
  Description of Artificial Sequence: Synthetic Light chain variable region amino acid sequence

SEQ ID NO: 571 - protein, 14 aa, Artificial Sequence
  Description of Artificial Sequence: Synthetic Light chain variable region CDR L1 amino acid sequence
GSSTGAVTTSNYAN

SEQ ID NO: 572 - DNA, 42 bp, Artificial Sequence; identical to SEQ ID NO: 204
  Description of Artificial Sequence: Synthetic Light chain variable region CDR L1 nucleic acid sequence

SEQ ID NO: 573 - protein, 7 aa, Artificial Sequence
  Description of Artificial Sequence: Synthetic Light chain variable region CDR L2 amino acid sequence
GTDKRAP

SEQ ID NO: 574 - DNA, 21 bp, Artificial Sequence
  Description of Artificial Sequence: Synthetic Light chain variable region CDR L2 nucleic acid sequence
ggcacagacaagcgcgctcct

SEQ ID NO: 575 - protein, 9 aa, Artificial Sequence
  Description of Artificial Sequence: Synthetic Light chain variable region CDR L3 amino acid sequence
ALWYSNHWV

SEQ ID NO: 576 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 577 - DNA, 375 bp, Artificial Sequence; identical to SEQ ID NO: 17
  Description of Artificial Sequence: Synthetic Heavy chain variable region nucleic acid sequence

SEQ ID NO: 578 - protein, 125 aa, Artificial Sequence; identical to SEQ ID NO: 18
  Description of Artificial Sequence: Synthetic Heavy chain variable region amino acid sequence

SEQ ID NO: 579 - protein, 9 aa, Artificial Sequence
  Description of Artificial Sequence: Synthetic Heavy chain variable region CDR H1 amino acid sequence
FTFDTYAMN

SEQ ID NO: 580 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 581 - protein, 19 aa, Artificial Sequence
  Description of Artificial Sequence: Synthetic Heavy chain variable region CDR H2 amino acid sequence
RIRSKYNNYATYYADSVKD

SEQ ID NO: 582 - DNA, 57 bp, Artificial Sequence; identical to SEQ ID NO: 6
  Description of Artificial Sequence: Synthetic Heavy chain variable region CDR H2 nucleic acid sequence

SEQ ID NO: 583 - protein, 16 aa, Artificial Sequence
  Description of Artificial Sequence: Synthetic Heavy chain variable region CDR H3 amino acid sequence
VRHGNFGNGYVSWFAH

SEQ ID NO: 584 - DNA, 48 bp, Artificial Sequence; identical to SEQ ID NO: 24
  Description of Artificial Sequence: Synthetic Heavy chain variable region CDR H3 nucleic acid sequence

SEQ ID NO: 585 - DNA, 327 bp, Artificial Sequence; identical to SEQ ID NO: 345
  Description of Artificial Sequence: Synthetic Light chain variable region nucleic acid sequence

SEQ ID NO: 586 - protein, 109 aa, Artificial Sequence; identical to SEQ ID NO: 346
  Description of Artificial Sequence: Synthetic Light chain variable region amino acid sequence

SEQ ID NO: 587 - protein, 14 aa, Artificial Sequence
  Description of Artificial Sequence: Synthetic Light chain variable region CDR L1 amino acid sequence
GSSTGAVTTSNYAN

SEQ ID NO: 588 - DNA, 42 bp, Artificial Sequence; identical to SEQ ID NO: 204
  Description of Artificial Sequence: Synthetic Light chain variable region CDR L1 nucleic acid sequence

SEQ ID NO: 589 - protein, 7 aa, Artificial Sequence
  Description of Artificial Sequence: Synthetic Light chain variable region CDR L2 amino acid sequence
GTDKRAP

SEQ ID NO: 590 - DNA, 21 bp, Artificial Sequence
  Description of Artificial Sequence: Synthetic Light chain variable region CDR L2 nucleic acid sequence
ggcacagacaagcgcgctcct

SEQ ID NO: 591 - protein, 9 aa, Artificial Sequence
  Description of Artificial Sequence: Synthetic Light chain variable region CDR L3 amino acid sequence
ALWYSNHWV

SEQ ID NO: 592 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 593 - DNA, 375 bp, Artificial Sequence; identical to SEQ ID NO: 17
  Description of Artificial Sequence: Synthetic Heavy chain variable region nucleic acid sequence

SEQ ID NO: 594 - protein, 125 aa, Artificial Sequence; identical to SEQ ID NO: 18
  Description of Artificial Sequence: Synthetic Heavy chain variable region amino acid sequence

SEQ ID NO: 595 - protein, 9 aa, Artificial Sequence
  Description of Artificial Sequence: Synthetic Heavy chain variable region CDR H1 amino acid sequence
FTFDTYAMN

SEQ ID NO: 596 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 597 - protein, 19 aa, Artificial Sequence
  Description of Artificial Sequence: Synthetic Heavy chain variable region CDR H2 amino acid sequence
RIRSKYNNYATYYADSVKD

SEQ ID NO: 598 - DNA, 57 bp, Artificial Sequence; identical to SEQ ID NO: 6
  Description of Artificial Sequence: Synthetic Heavy chain variable region CDR H2 nucleic acid sequence

SEQ ID NO: 599 - protein, 16 aa, Artificial Sequence
  Description of Artificial Sequence: Synthetic Heavy chain variable region CDR H3 amino acid sequence
VRHGNFGNGYVSWFAH

SEQ ID NO: 600 - DNA, 48 bp, Artificial Sequence; identical to SEQ ID NO: 24
  Description of Artificial Sequence: Synthetic Heavy chain variable region CDR H3 nucleic acid sequence

SEQ ID NO: 601 - DNA, 327 bp, Artificial Sequence; identical to SEQ ID NO: 345
  Description of Artificial Sequence: Synthetic Light chain variable region nucleic acid sequence

SEQ ID NO: 602 - protein, 109 aa, Artificial Sequence; identical to SEQ ID NO: 346
  Description of Artificial Sequence: Synthetic Light chain variable region amino acid sequence

SEQ ID NO: 603 - protein, 14 aa, Artificial Sequence
  Description of Artificial Sequence: Synthetic Light chain variable region CDR L1 amino acid sequence
GSSTGAVTTSNYAN

SEQ ID NO: 604 - DNA, 42 bp, Artificial Sequence; identical to SEQ ID NO: 204
  Description of Artificial Sequence: Synthetic Light chain variable region CDR L1 nucleic acid sequence

SEQ ID NO: 605 - protein, 7 aa, Artificial Sequence
  Description of Artificial Sequence: Synthetic Light chain variable region CDR L2 amino acid sequence
GTDKRAP

SEQ ID NO: 606 - DNA, 21 bp, Artificial Sequence
  Description of Artificial Sequence: Synthetic Light chain variable region CDR L2 nucleic acid sequence
ggcacagacaagcgcgctcct

SEQ ID NO: 607 - protein, 9 aa, Artificial Sequence
  Description of Artificial Sequence: Synthetic Light chain variable region CDR L3 amino acid sequence
ALWYSNHWV

SEQ ID NO: 608 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 609 - DNA, 375 bp, Artificial Sequence; identical to SEQ ID NO: 17
  Description of Artificial Sequence: Synthetic Heavy chain variable region nucleic acid sequence

SEQ ID NO: 610 - protein, 125 aa, Artificial Sequence; identical to SEQ ID NO: 18
  Description of Artificial Sequence: Synthetic Heavy chain variable region amino acid sequence

SEQ ID NO: 611 - protein, 9 aa, Artificial Sequence
  Description of Artificial Sequence: Synthetic Heavy chain variable region CDR H1 amino acid sequence
FTFDTYAMN

SEQ ID NO: 612 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 613 - protein, 19 aa, Artificial Sequence
  Description of Artificial Sequence: Synthetic Heavy chain variable region CDR H2 amino acid sequence
RIRSKYNNYATYYADSVKD

SEQ ID NO: 614 - DNA, 57 bp, Artificial Sequence; identical to SEQ ID NO: 6
  Description of Artificial Sequence: Synthetic Heavy chain variable region CDR H2 nucleic acid sequence

SEQ ID NO: 615 - protein, 16 aa, Artificial Sequence
  Description of Artificial Sequence: Synthetic Heavy chain variable region CDR H3 amino acid sequence
VRHGNFGNGYVSWFAH

SEQ ID NO: 616 - DNA, 48 bp, Artificial Sequence; identical to SEQ ID NO: 24
  Description of Artificial Sequence: Synthetic Heavy chain variable region CDR H3 nucleic acid sequence

SEQ ID NO: 617 - DNA, 327 bp, Artificial Sequence; identical to SEQ ID NO: 345
  Description of Artificial Sequence: Synthetic Light chain variable region nucleic acid sequence

SEQ ID NO: 618 - protein, 109 aa, Artificial Sequence; identical to SEQ ID NO: 346
  Description of Artificial Sequence: Synthetic Light chain variable region amino acid sequence

SEQ ID NO: 619 - protein, 14 aa, Artificial Sequence
  Description of Artificial Sequence: Synthetic Light chain variable region CDR L1 amino acid sequence
GSSTGAVTTSNYAN

SEQ ID NO: 620 - DNA, 42 bp, Artificial Sequence; identical to SEQ ID NO: 204
  Description of Artificial Sequence: Synthetic Light chain variable region CDR L1 nucleic acid sequence

SEQ ID NO: 621 - protein, 7 aa, Artificial Sequence
  Description of Artificial Sequence: Synthetic Light chain variable region CDR L2 amino acid sequence
GTDKRAP

SEQ ID NO: 622 - DNA, 21 bp, Artificial Sequence
  Description of Artificial Sequence: Synthetic Light chain variable region CDR L2 nucleic acid sequence
ggcacagacaagcgcgctcct

SEQ ID NO: 623 - protein, 9 aa, Artificial Sequence
  Description of Artificial Sequence: Synthetic Light chain variable region CDR L3 amino acid sequence
ALWYSNHWV

SEQ ID NO: 624 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 625 - DNA, 375 bp, Artificial Sequence; identical to SEQ ID NO: 17
  Description of Artificial Sequence: Synthetic Heavy chain variable region nucleic acid sequence

SEQ ID NO: 626 - protein, 125 aa, Artificial Sequence; identical to SEQ ID NO: 18
  Description of Artificial Sequence: Synthetic Heavy chain variable region amino acid sequence

SEQ ID NO: 627 - protein, 9 aa, Artificial Sequence
  Description of Artificial Sequence: Synthetic Heavy chain variable region CDR H1 amino acid sequence
FTFDTYAMN

SEQ ID NO: 628 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 629 - protein, 19 aa, Artificial Sequence
  Description of Artificial Sequence: Synthetic Heavy chain variable region CDR H2 amino acid sequence
RIRSKYNNYATYYADSVKD

SEQ ID NO: 630 - DNA, 57 bp, Artificial Sequence; identical to SEQ ID NO: 6
  Description of Artificial Sequence: Synthetic Heavy chain variable region CDR H2 nucleic acid sequence

SEQ ID NO: 631 - protein, 16 aa, Artificial Sequence
  Description of Artificial Sequence: Synthetic Heavy chain variable region CDR H3 amino acid sequence
VRHGNFGNGYVSWFAH

SEQ ID NO: 632 - DNA, 48 bp, Artificial Sequence; identical to SEQ ID NO: 24
  Description of Artificial Sequence: Synthetic Heavy chain variable region CDR H3 nucleic acid sequence

SEQ ID NO: 633 - DNA, 327 bp, Artificial Sequence; identical to SEQ ID NO: 345
  Description of Artificial Sequence: Synthetic Light chain variable region nucleic acid sequence

SEQ ID NO: 634 - protein, 109 aa, Artificial Sequence; identical to SEQ ID NO: 346
  Description of Artificial Sequence: Synthetic Light chain variable region amino acid sequence

SEQ ID NO: 635 - protein, 14 aa, Artificial Sequence
  Description of Artificial Sequence: Synthetic Light chain variable region CDR L1 amino acid sequence
GSSTGAVTTSNYAN

SEQ ID NO: 636 - DNA, 42 bp, Artificial Sequence; identical to SEQ ID NO: 204
  Description of Artificial Sequence: Synthetic Light chain variable region CDR L1 nucleic acid sequence

SEQ ID NO: 637 - protein, 7 aa, Artificial Sequence
  Description of Artificial Sequence: Synthetic Light chain variable region CDR L2 amino acid sequence
GTDKRAP

SEQ ID NO: 638 - DNA, 21 bp, Artificial Sequence
  Description of Artificial Sequence: Synthetic Light chain variable region CDR L2 nucleic acid sequence
ggcacagacaagcgcgctcct

SEQ ID NO: 639 - protein, 9 aa, Artificial Sequence
  Description of Artificial Sequence: Synthetic Light chain variable region CDR L3 amino acid sequence
ALWYSNHWV

SEQ ID NO: 640 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 641 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactactcatactccgtgaaggatcggttcaccatctccagagacgattccaagagcacgctgtatctgcaaatgaacagcctgagagccgaggacacggcggtgtactactgcgtcaggcacggtaacttcgggaacggttacgtatcctggtttgctcattggggccaaggaaccctggtcaccgtctcctca

SEQ ID NO: 642 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYSYSVKDRFTISRDDSKSTLYLQMNSLRAEDTAVYYCVRHGNFGNGYVSWFAHWGQGTLVTVSS

SEQ ID NO: 643 - protein, 9 aa, Artificial Sequence
  Description of Artificial Sequence: Synthetic Heavy chain variable region CDR H1 amino acid sequence
FTFDTYAMN

SEQ ID NO: 644 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 645 - protein, 19 aa, Artificial Sequence
  Description of Artificial Sequence: Synthetic Heavy chain variable region CDR H2 amino acid sequence
RIRSKYNNYATYYSYSVKD

SEQ ID NO: 646 - DNA, 57 bp, Artificial Sequence
  Description of Artificial Sequence: Synthetic Heavy chain variable region CDR H2 nucleic acid sequence
aggattagatccaagtataacaattacgctacatactactcatactccgtgaaggat

SEQ ID NO: 647 - protein, 16 aa, Artificial Sequence
  Description of Artificial Sequence: Synthetic Heavy chain variable region CDR H3 amino acid sequence
VRHGNFGNGYVSWFAH

SEQ ID NO: 648 - DNA, 48 bp, Artificial Sequence; identical to SEQ ID NO: 24
  Description of Artificial Sequence: Synthetic Heavy chain variable region CDR H3 nucleic acid sequence

SEQ ID NO: 649 - DNA, 327 bp, Artificial Sequence; identical to SEQ ID NO: 345
  Description of Artificial Sequence: Synthetic Light chain variable region nucleic acid sequence

SEQ ID NO: 650 - protein, 109 aa, Artificial Sequence; identical to SEQ ID NO: 346
  Description of Artificial Sequence: Synthetic Light chain variable region amino acid sequence

SEQ ID NO: 651 - protein, 14 aa, Artificial Sequence
  Description of Artificial Sequence: Synthetic Light chain variable region CDR L1 amino acid sequence
GSSTGAVTTSNYAN

SEQ ID NO: 652 - DNA, 42 bp, Artificial Sequence; identical to SEQ ID NO: 204
  Description of Artificial Sequence: Synthetic Light chain variable region CDR L1 nucleic acid sequence

SEQ ID NO: 653 - protein, 7 aa, Artificial Sequence
  Description of Artificial Sequence: Synthetic Light chain variable region CDR L2 amino acid sequence
GTDKRAP

SEQ ID NO: 654 - DNA, 21 bp, Artificial Sequence
  Description of Artificial Sequence: Synthetic Light chain variable region CDR L2 nucleic acid sequence
ggcacagacaagcgcgctcct

SEQ ID NO: 655 - protein, 9 aa, Artificial Sequence
  Description of Artificial Sequence: Synthetic Light chain variable region CDR L3 amino acid sequence
ALWYSNHWV

SEQ ID NO: 656 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 657 - DNA, 375 bp, Artificial Sequence; identical to SEQ ID NO: 17
  Description of Artificial Sequence: Synthetic Heavy chain variable region nucleic acid sequence

SEQ ID NO: 658 - protein, 125 aa, Artificial Sequence; identical to SEQ ID NO: 18
  Description of Artificial Sequence: Synthetic Heavy chain variable region amino acid sequence

SEQ ID NO: 659 - protein, 9 aa, Artificial Sequence
  Description of Artificial Sequence: Synthetic Heavy chain variable region CDR H1 amino acid sequence
FTFDTYAMN

SEQ ID NO: 660 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 661 - protein, 19 aa, Artificial Sequence
  Description of Artificial Sequence: Synthetic Heavy chain variable region CDR H2 amino acid sequence
RIRSKYNNYATYYADSVKD

SEQ ID NO: 662 - DNA, 57 bp, Artificial Sequence; identical to SEQ ID NO: 6
  Description of Artificial Sequence: Synthetic Heavy chain variable region CDR H2 nucleic acid sequence

SEQ ID NO: 663 - protein, 16 aa, Artificial Sequence
  Description of Artificial Sequence: Synthetic Heavy chain variable region CDR H3 amino acid sequence
VRHGNFGNGYVSWFAH

SEQ ID NO: 664 - DNA, 48 bp, Artificial Sequence; identical to SEQ ID NO: 24
  Description of Artificial Sequence: Synthetic Heavy chain variable region CDR H3 nucleic acid sequence

SEQ ID NO: 665 - DNA, 327 bp, Artificial Sequence; identical to SEQ ID NO: 345
  Description of Artificial Sequence: Synthetic Light chain variable region nucleic acid sequence

SEQ ID NO: 666 - protein, 109 aa, Artificial Sequence; identical to SEQ ID NO: 346
  Description of Artificial Sequence: Synthetic Light chain variable region amino acid sequence

SEQ ID NO: 667 - protein, 14 aa, Artificial Sequence
  Description of Artificial Sequence: Synthetic Light chain variable region CDR L1 amino acid sequence
GSSTGAVTTSNYAN

SEQ ID NO: 668 - DNA, 42 bp, Artificial Sequence; identical to SEQ ID NO: 204
  Description of Artificial Sequence: Synthetic Light chain variable region CDR L1 nucleic acid sequence

SEQ ID NO: 669 - protein, 7 aa, Artificial Sequence
  Description of Artificial Sequence: Synthetic Light chain variable region CDR L2 amino acid sequence
GTDKRAP

SEQ ID NO: 670 - DNA, 21 bp, Artificial Sequence
  Description of Artificial Sequence: Synthetic Light chain variable region CDR L2 nucleic acid sequence
ggcacagacaagcgcgctcct

SEQ ID NO: 671 - protein, 9 aa, Artificial Sequence
  Description of Artificial Sequence: Synthetic Light chain variable region CDR L3 amino acid sequence
ALWYSNHWV

SEQ ID NO: 672 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 673 - DNA, 375 bp, Artificial Sequence; identical to SEQ ID NO: 17
  Description of Artificial Sequence: Synthetic Heavy chain variable region nucleic acid sequence

SEQ ID NO: 674 - protein, 125 aa, Artificial Sequence; identical to SEQ ID NO: 18
  Description of Artificial Sequence: Synthetic Heavy chain variable region amino acid sequence

SEQ ID NO: 675 - protein, 9 aa, Artificial Sequence
  Description of Artificial Sequence: Synthetic Heavy chain variable region CDR H1 amino acid sequence
FTFDTYAMN

SEQ ID NO: 676 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 677 - protein, 19 aa, Artificial Sequence
  Description of Artificial Sequence: Synthetic Heavy chain variable region CDR H2 amino acid sequence
RIRSKYNNYATYYADSVKD

SEQ ID NO: 678 - DNA, 57 bp, Artificial Sequence; identical to SEQ ID NO: 6
  Description of Artificial Sequence: Synthetic Heavy chain variable region CDR H2 nucleic acid sequence

SEQ ID NO: 679 - protein, 16 aa, Artificial Sequence
  Description of Artificial Sequence: Synthetic Heavy chain variable region CDR H3 amino acid sequence
VRHGNFGNGYVSWFAH

SEQ ID NO: 680 - DNA, 48 bp, Artificial Sequence; identical to SEQ ID NO: 24
  Description of Artificial Sequence: Synthetic Heavy chain variable region CDR H3 nucleic acid sequence

SEQ ID NO: 681 - DNA, 327 bp, Artificial Sequence; identical to SEQ ID NO: 345
  Description of Artificial Sequence: Synthetic Light chain variable region nucleic acid sequence

SEQ ID NO: 682 - protein, 109 aa, Artificial Sequence; identical to SEQ ID NO: 346
  Description of Artificial Sequence: Synthetic Light chain variable region amino acid sequence

SEQ ID NO: 683 - protein, 14 aa, Artificial Sequence
  Description of Artificial Sequence: Synthetic Light chain variable region CDR L1 amino acid sequence
GSSTGAVTTSNYAN

SEQ ID NO: 684 - DNA, 42 bp, Artificial Sequence; identical to SEQ ID NO: 204
  Description of Artificial Sequence: Synthetic Light chain variable region CDR L1 nucleic acid sequence

SEQ ID NO: 685 - protein, 7 aa, Artificial Sequence
  Description of Artificial Sequence: Synthetic Light chain variable region CDR L2 amino acid sequence
GTDKRAP

SEQ ID NO: 686 - DNA, 21 bp, Artificial Sequence
  Description of Artificial Sequence: Synthetic Light chain variable region CDR L2 nucleic acid sequence
ggcacagacaagcgcgctcct

SEQ ID NO: 687 - protein, 9 aa, Artificial Sequence
  Description of Artificial Sequence: Synthetic Light chain variable region CDR L3 amino acid sequence
ALWYSNHWV

SEQ ID NO: 688 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 689 - DNA, 375 bp, Artificial Sequence; identical to SEQ ID NO: 17
  Description of Artificial Sequence: Synthetic Heavy chain variable region nucleic acid sequence

SEQ ID NO: 690 - protein, 125 aa, Artificial Sequence; identical to SEQ ID NO: 18
  Description of Artificial Sequence: Synthetic Heavy chain variable region amino acid sequence

SEQ ID NO: 691 - protein, 9 aa, Artificial Sequence
  Description of Artificial Sequence: Synthetic Heavy chain variable region CDR H1 amino acid sequence
FTFDTYAMN

SEQ ID NO: 692 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 693 - protein, 19 aa, Artificial Sequence
  Description of Artificial Sequence: Synthetic Heavy chain variable region CDR H2 amino acid sequence
RIRSKYNNYATYYADSVKD

SEQ ID NO: 694 - DNA, 57 bp, Artificial Sequence; identical to SEQ ID NO: 6
  Description of Artificial Sequence: Synthetic Heavy chain variable region CDR H2 nucleic acid sequence

SEQ ID NO: 695 - protein, 16 aa, Artificial Sequence
  Description of Artificial Sequence: Synthetic Heavy chain variable region CDR H3 amino acid sequence
VRHGNFGNGYVSWFAH

SEQ ID NO: 696 - DNA, 48 bp, Artificial Sequence; identical to SEQ ID NO: 24
  Description of Artificial Sequence: Synthetic Heavy chain variable region CDR H3 nucleic acid sequence

SEQ ID NO: 697 - DNA, 327 bp, Artificial Sequence; identical to SEQ ID NO: 345
  Description of Artificial Sequence: Synthetic Light chain variable region nucleic acid sequence

SEQ ID NO: 698 - protein, 109 aa, Artificial Sequence; identical to SEQ ID NO: 346
  Description of Artificial Sequence: Synthetic Light chain variable region amino acid sequence

SEQ ID NO: 699 - protein, 14 aa, Artificial Sequence
  Description of Artificial Sequence: Synthetic Light chain variable region CDR L1 amino acid sequence
GSSTGAVTTSNYAN

SEQ ID NO: 700 - DNA, 42 bp, Artificial Sequence; identical to SEQ ID NO: 204
  Description of Artificial Sequence: Synthetic Light chain variable region CDR L1 nucleic acid sequence

SEQ ID NO: 701 - protein, 7 aa, Artificial Sequence
  Description of Artificial Sequence: Synthetic Light chain variable region CDR L2 amino acid sequence
GTDKRAP

SEQ ID NO: 702 - DNA, 21 bp, Artificial Sequence
  Description of Artificial Sequence: Synthetic Light chain variable region CDR L2 nucleic acid sequence
ggcacagacaagcgcgctcct

SEQ ID NO: 703 - protein, 9 aa, Artificial Sequence
  Description of Artificial Sequence: Synthetic Light chain variable region CDR L3 amino acid sequence
ALWYSNHWV

SEQ ID NO: 704 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 705 - DNA, 375 bp, Artificial Sequence; identical to SEQ ID NO: 17
  Description of Artificial Sequence: Synthetic Heavy chain variable region nucleic acid sequence

SEQ ID NO: 706 - protein, 125 aa, Artificial Sequence; identical to SEQ ID NO: 18
  Description of Artificial Sequence: Synthetic Heavy chain variable region amino acid sequence

SEQ ID NO: 707 - protein, 9 aa, Artificial Sequence
  Description of Artificial Sequence: Synthetic Heavy chain variable region CDR H1 amino acid sequence
FTFDTYAMN

SEQ ID NO: 708 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 709 - protein, 19 aa, Artificial Sequence
  Description of Artificial Sequence: Synthetic Heavy chain variable region CDR H2 amino acid sequence
RIRSKYNNYATYYADSVKD

SEQ ID NO: 710 - DNA, 57 bp, Artificial Sequence; identical to SEQ ID NO: 6
  Description of Artificial Sequence: Synthetic Heavy chain variable region CDR H2 nucleic acid sequence

SEQ ID NO: 711 - protein, 16 aa, Artificial Sequence
  Description of Artificial Sequence: Synthetic Heavy chain variable region CDR H3 amino acid sequence
VRHGNFGNGYVSWFAH

SEQ ID NO: 712 - DNA, 48 bp, Artificial Sequence; identical to SEQ ID NO: 24
  Description of Artificial Sequence: Synthetic Heavy chain variable region CDR H3 nucleic acid sequence

SEQ ID NO: 713 - DNA, 327 bp, Artificial Sequence; identical to SEQ ID NO: 345
  Description of Artificial Sequence: Synthetic Light chain variable region nucleic acid sequence

SEQ ID NO: 714 - protein, 109 aa, Artificial Sequence; identical to SEQ ID NO: 346
  Description of Artificial Sequence: Synthetic Light chain variable region amino acid sequence

SEQ ID NO: 715 - protein, 14 aa, Artificial Sequence
  Description of Artificial Sequence: Synthetic Light chain variable region CDR L1 amino acid sequence
GSSTGAVTTSNYAN

SEQ ID NO: 716 - DNA, 42 bp, Artificial Sequence; identical to SEQ ID NO: 204
  Description of Artificial Sequence: Synthetic Light chain variable region CDR L1 nucleic acid sequence

SEQ ID NO: 717 - protein, 7 aa, Artificial Sequence
  Description of Artificial Sequence: Synthetic Light chain variable region CDR L2 amino acid sequence
GTDKRAP

SEQ ID NO: 718 - DNA, 21 bp, Artificial Sequence
  Description of Artificial Sequence: Synthetic Light chain variable region CDR L2 nucleic acid sequence
ggcacagacaagcgcgctcct

SEQ ID NO: 719 - protein, 9 aa, Artificial Sequence
  Description of Artificial Sequence: Synthetic Light chain variable region CDR L3 amino acid sequence
ALWYSNHWV

SEQ ID NO: 720 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 721 - DNA, 375 bp, Artificial Sequence; identical to SEQ ID NO: 17
  Description of Artificial Sequence: Synthetic Heavy chain variable region nucleic acid sequence

SEQ ID NO: 722 - protein, 125 aa, Artificial Sequence; identical to SEQ ID NO: 18
  Description of Artificial Sequence: Synthetic Heavy chain variable region amino acid sequence

SEQ ID NO: 723 - protein, 9 aa, Artificial Sequence
  Description of Artificial Sequence: Synthetic Heavy chain variable region CDR H1 amino acid sequence
FTFDTYAMN

SEQ ID NO: 724 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 725 - protein, 19 aa, Artificial Sequence
  Description of Artificial Sequence: Synthetic Heavy chain variable region CDR H2 amino acid sequence
RIRSKYNNYATYYADSVKD

SEQ ID NO: 726 - DNA, 57 bp, Artificial Sequence; identical to SEQ ID NO: 6
  Description of Artificial Sequence: Synthetic Heavy chain variable region CDR H2 nucleic acid sequence

SEQ ID NO: 727 - protein, 16 aa, Artificial Sequence
  Description of Artificial Sequence: Synthetic Heavy chain variable region CDR H3 amino acid sequence
VRHGNFGNGYVSWFAH

SEQ ID NO: 728 - DNA, 48 bp, Artificial Sequence; identical to SEQ ID NO: 24
  Description of Artificial Sequence: Synthetic Heavy chain variable region CDR H3 nucleic acid sequence

SEQ ID NO: 729 - DNA, 327 bp, Artificial Sequence; identical to SEQ ID NO: 345
  Description of Artificial Sequence: Synthetic Light chain variable region nucleic acid sequence

SEQ ID NO: 730 - protein, 109 aa, Artificial Sequence; identical to SEQ ID NO: 346
  Description of Artificial Sequence: Synthetic Light chain variable region amino acid sequence

SEQ ID NO: 731 - protein, 14 aa, Artificial Sequence
  Description of Artificial Sequence: Synthetic Light chain variable region CDR L1 amino acid sequence
GSSTGAVTTSNYAN

SEQ ID NO: 732 - DNA, 42 bp, Artificial Sequence; identical to SEQ ID NO: 204
  Description of Artificial Sequence: Synthetic Light chain variable region CDR L1 nucleic acid sequence

SEQ ID NO: 733 - protein, 7 aa, Artificial Sequence
  Description of Artificial Sequence: Synthetic Light chain variable region CDR L2 amino acid sequence
GTDKRAP

SEQ ID NO: 734 - DNA, 21 bp, Artificial Sequence
  Description of Artificial Sequence: Synthetic Light chain variable region CDR L2 nucleic acid sequence
ggcacagacaagcgcgctcct

SEQ ID NO: 735 - protein, 9 aa, Artificial Sequence
  Description of Artificial Sequence: Synthetic Light chain variable region CDR L3 amino acid sequence
ALWYSNHWV

SEQ ID NO: 736 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 737 - DNA, 375 bp, Artificial Sequence; identical to SEQ ID NO: 17
  Description of Artificial Sequence: Synthetic Heavy chain variable region nucleic acid sequence

SEQ ID NO: 738 - protein, 125 aa, Artificial Sequence; identical to SEQ ID NO: 18
  Description of Artificial Sequence: Synthetic Heavy chain variable region amino acid sequence

SEQ ID NO: 739 - protein, 9 aa, Artificial Sequence
  Description of Artificial Sequence: Synthetic Heavy chain variable region CDR H1 amino acid sequence
FTFDTYAMN

SEQ ID NO: 740 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 741 - protein, 19 aa, Artificial Sequence
  Description of Artificial Sequence: Synthetic Heavy chain variable region CDR H2 amino acid sequence
RIRSKYNNYATYYADSVKD

SEQ ID NO: 742 - DNA, 57 bp, Artificial Sequence; identical to SEQ ID NO: 6
  Description of Artificial Sequence: Synthetic Heavy chain variable region CDR H2 nucleic acid sequence

SEQ ID NO: 743 - protein, 16 aa, Artificial Sequence
  Description of Artificial Sequence: Synthetic Heavy chain variable region CDR H3 amino acid sequence
VRHGNFGNGYVSWFAH

SEQ ID NO: 744 - DNA, 48 bp, Artificial Sequence; identical to SEQ ID NO: 24
  Description of Artificial Sequence: Synthetic Heavy chain variable region CDR H3 nucleic acid sequence

SEQ ID NO: 745 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgtttctctggctccctgcttggggacaaagctgccctcaccatcacgggggcccaggcagaggatgaagctgattattactgtgcgctgtggtacagtaaccattgggtgttcggcggagggaccaagctgaccgtccta

SEQ ID NO: 746 - protein, 109 aa, Artificial Sequence; identical to SEQ ID NO: 346
  Description of Artificial Sequence: Synthetic Light chain variable region amino acid sequence

SEQ ID NO: 747 - protein, 14 aa, Artificial Sequence
  Description of Artificial Sequence: Synthetic Light chain variable region CDR L1 amino acid sequence
GSSTGAVTTSNYAN

SEQ ID NO: 748 - DNA, 42 bp, Artificial Sequence; identical to SEQ ID NO: 204
  Description of Artificial Sequence: Synthetic Light chain variable region CDR L1 nucleic acid sequence

SEQ ID NO: 749 - protein, 7 aa, Artificial Sequence
  Description of Artificial Sequence: Synthetic Light chain variable region CDR L2 amino acid sequence
GTDKRAP

SEQ ID NO: 750 - DNA, 21 bp, Artificial Sequence
  Description of Artificial Sequence: Synthetic Light chain variable region CDR L2 nucleic acid sequence
ggcacagacaagcgcgctcct

SEQ ID NO: 751 - protein, 9 aa, Artificial Sequence
  Description of Artificial Sequence: Synthetic Light chain variable region CDR L3 amino acid sequence
ALWYSNHWV

SEQ ID NO: 752 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 753 - DNA, 375 bp, Artificial Sequence; identical to SEQ ID NO: 17
  Description of Artificial Sequence: Synthetic Heavy chain variable region nucleic acid sequence

SEQ ID NO: 754 - protein, 125 aa, Artificial Sequence; identical to SEQ ID NO: 18
  Description of Artificial Sequence: Synthetic Heavy chain variable region amino acid sequence

SEQ ID NO: 755 - protein, 9 aa, Artificial Sequence
  Description of Artificial Sequence: Synthetic Heavy chain variable region CDR H1 amino acid sequence
FTFDTYAMN

SEQ ID NO: 756 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 757 - protein, 19 aa, Artificial Sequence
  Description of Artificial Sequence: Synthetic Heavy chain variable region CDR H2 amino acid sequence
RIRSKYNNYATYYADSVKD

SEQ ID NO: 758 - DNA, 57 bp, Artificial Sequence; identical to SEQ ID NO: 6
  Description of Artificial Sequence: Synthetic Heavy chain variable region CDR H2 nucleic acid sequence

SEQ ID NO: 759 - protein, 16 aa, Artificial Sequence
  Description of Artificial Sequence: Synthetic Heavy chain variable region CDR H3 amino acid sequence
VRHGNFGNGYVSWFAH

SEQ ID NO: 760 - DNA, 48 bp, Artificial Sequence; identical to SEQ ID NO: 24
  Description of Artificial Sequence: Synthetic Heavy chain variable region CDR H3 nucleic acid sequence

SEQ ID NO: 761 - DNA, 327 bp, Artificial Sequence; identical to SEQ ID NO: 345
  Description of Artificial Sequence: Synthetic Light chain variable region nucleic acid sequence

SEQ ID NO: 762 - protein, 109 aa, Artificial Sequence; identical to SEQ ID NO: 346
  Description of Artificial Sequence: Synthetic Light chain variable region amino acid sequence

SEQ ID NO: 763 - protein, 14 aa, Artificial Sequence
  Description of Artificial Sequence: Synthetic Light chain variable region CDR L1 amino acid sequence
GSSTGAVTTSNYAN

SEQ ID NO: 764 - DNA, 42 bp, Artificial Sequence; identical to SEQ ID NO: 204
  Description of Artificial Sequence: Synthetic Light chain variable region CDR L1 nucleic acid sequence

SEQ ID NO: 765 - protein, 7 aa, Artificial Sequence
  Description of Artificial Sequence: Synthetic Light chain variable region CDR L2 amino acid sequence
GTDKRAP

SEQ ID NO: 766 - DNA, 21 bp, Artificial Sequence
  Description of Artificial Sequence: Synthetic Light chain variable region CDR L2 nucleic acid sequence
ggcacagacaagcgcgctcct

SEQ ID NO: 767 - protein, 9 aa, Artificial Sequence
  Description of Artificial Sequence: Synthetic Light chain variable region CDR L3 amino acid sequence
ALWYSNHWV

SEQ ID NO: 768 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 769 - DNA, 375 bp, Artificial Sequence; identical to SEQ ID NO: 17
  Description of Artificial Sequence: Synthetic Heavy chain variable region nucleic acid sequence

SEQ ID NO: 770 - protein, 125 aa, Artificial Sequence; identical to SEQ ID NO: 18
  Description of Artificial Sequence: Synthetic Heavy chain variable region amino acid sequence

SEQ ID NO: 771 - protein, 9 aa, Artificial Sequence
  Description of Artificial Sequence: Synthetic Heavy chain variable region CDR H1 amino acid sequence
FTFDTYAMN

SEQ ID NO: 772 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 773 - protein, 19 aa, Artificial Sequence
  Description of Artificial Sequence: Synthetic Heavy chain variable region CDR H2 amino acid sequence
RIRSKYNNYATYYADSVKD

SEQ ID NO: 774 - DNA, 57 bp, Artificial Sequence; identical to SEQ ID NO: 6
  Description of Artificial Sequence: Synthetic Heavy chain variable region CDR H2 nucleic acid sequence

SEQ ID NO: 775 - protein, 16 aa, Artificial Sequence
  Description of Artificial Sequence: Synthetic Heavy chain variable region CDR H3 amino acid sequence
VRHGNFGNGYVSWFAH

SEQ ID NO: 776 - DNA, 48 bp, Artificial Sequence; identical to SEQ ID NO: 24
  Description of Artificial Sequence: Synthetic Heavy chain variable region CDR H3 nucleic acid sequence

SEQ ID NO: 777 - DNA, 327 bp, Artificial Sequence; identical to SEQ ID NO: 345
  Description of Artificial Sequence: Synthetic Light chain variable region nucleic acid sequence

SEQ ID NO: 778 - protein, 109 aa, Artificial Sequence; identical to SEQ ID NO: 346
  Description of Artificial Sequence: Synthetic Light chain variable region amino acid sequence

SEQ ID NO: 779 - protein, 14 aa, Artificial Sequence
  Description of Artificial Sequence: Synthetic Light chain variable region CDR L1 amino acid sequence
GSSTGAVTTSNYAN

SEQ ID NO: 780 - DNA, 42 bp, Artificial Sequence; identical to SEQ ID NO: 204
  Description of Artificial Sequence: Synthetic Light chain variable region CDR L1 nucleic acid sequence

SEQ ID NO: 781 - protein, 7 aa, Artificial Sequence
  Description of Artificial Sequence: Synthetic Light chain variable region CDR L2 amino acid sequence
GTDKRAP

SEQ ID NO: 782 - DNA, 21 bp, Artificial Sequence
  Description of Artificial Sequence: Synthetic Light chain variable region CDR L2 nucleic acid sequence
ggcacagacaagcgcgctcct

SEQ ID NO: 783 - protein, 9 aa, Artificial Sequence
  Description of Artificial Sequence: Synthetic Light chain variable region CDR L3 amino acid sequence
ALWYSNHWV

SEQ ID NO: 784 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 785 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaagtgtctggagtgggtcgcaaggattagatccaagtataacaattacgctacatactacgcagactccgtgaaggatcggttcaccatctccagagacgattccaagagcacgctgtatctgcaaatgaacagcctgagagccgaggacacggcggtgtactactgcgtcaggcacggtaacttcgggaacggttacgtatcctggtttgctcattggggccaaggaaccctggtcaccgtctcctca

SEQ ID NO: 786 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKCLEWVARIRSKYNNYATYYADSVKDRFTISRDDSKSTLYLQMNSLRAEDTAVYYCVRHGNFGNGYVSWFAHWGQGTLVTVSS

SEQ ID NO: 787 - protein, 9 aa, Artificial Sequence
  Description of Artificial Sequence: Synthetic Heavy chain variable region CDR H1 amino acid sequence
FTFDTYAMN

SEQ ID NO: 788 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 789 - protein, 19 aa, Artificial Sequence
  Description of Artificial Sequence: Synthetic Heavy chain variable region CDR H2 amino acid sequence
RIRSKYNNYATYYADSVKD

SEQ ID NO: 790 - DNA, 57 bp, Artificial Sequence; identical to SEQ ID NO: 6
  Description of Artificial Sequence: Synthetic Heavy chain variable region CDR H2 nucleic acid sequence

SEQ ID NO: 791 - protein, 16 aa, Artificial Sequence
  Description of Artificial Sequence: Synthetic Heavy chain variable region CDR H3 amino acid sequence
VRHGNFGNGYVSWFAH

SEQ ID NO: 792 - DNA, 48 bp, Artificial Sequence; identical to SEQ ID NO: 24
  Description of Artificial Sequence: Synthetic Heavy chain variable region CDR H3 nucleic acid sequence

SEQ ID NO: 793 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagaggatgaagctgattattactgtgcgctgtggtacagtaaccattgggtgttcggctgtgggaccaagctgaccgtccta

SEQ ID NO: 794 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQAEDEADYYCALWYSNHWVFGCGTKLTVL

SEQ ID NO: 795 - protein, 14 aa, Artificial Sequence
  Description of Artificial Sequence: Synthetic Light chain variable region CDR L1 amino acid sequence
GSSTGAVTTSNYAN

SEQ ID NO: 796 - DNA, 42 bp, Artificial Sequence; identical to SEQ ID NO: 204
  Description of Artificial Sequence: Synthetic Light chain variable region CDR L1 nucleic acid sequence

SEQ ID NO: 797 - protein, 7 aa, Artificial Sequence
  Description of Artificial Sequence: Synthetic Light chain variable region CDR L2 amino acid sequence
GTDKRAP

SEQ ID NO: 798 - DNA, 21 bp, Artificial Sequence
  Description of Artificial Sequence: Synthetic Light chain variable region CDR L2 nucleic acid sequence
ggcacagacaagcgcgctcct

SEQ ID NO: 799 - protein, 9 aa, Artificial Sequence
  Description of Artificial Sequence: Synthetic Light chain variable region CDR L3 amino acid sequence
ALWYSNHWV

SEQ ID NO: 800 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 801 - DNA, 375 bp, Artificial Sequence; identical to SEQ ID NO: 785
  Description of Artificial Sequence: Synthetic Heavy chain variable region nucleic acid sequence

SEQ ID NO: 802 - protein, 125 aa, Artificial Sequence; identical to SEQ ID NO: 786
  Description of Artificial Sequence: Synthetic Heavy chain variable region amino acid sequence

SEQ ID NO: 803 - protein, 9 aa, Artificial Sequence
  Description of Artificial Sequence: Synthetic Heavy chain variable region CDR H1 amino acid sequence
FTFDTYAMN

SEQ ID NO: 804 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 805 - protein, 19 aa, Artificial Sequence
  Description of Artificial Sequence: Synthetic Heavy chain variable region CDR H2 amino acid sequence
RIRSKYNNYATYYADSVKD

SEQ ID NO: 806 - DNA, 57 bp, Artificial Sequence; identical to SEQ ID NO: 6
  Description of Artificial Sequence: Synthetic Heavy chain variable region CDR H2 nucleic acid sequence

SEQ ID NO: 807 - protein, 16 aa, Artificial Sequence
  Description of Artificial Sequence: Synthetic Heavy chain variable region CDR H3 amino acid sequence
VRHGNFGNGYVSWFAH

SEQ ID NO: 808 - DNA, 48 bp, Artificial Sequence; identical to SEQ ID NO: 24
  Description of Artificial Sequence: Synthetic Heavy chain variable region CDR H3 nucleic acid sequence

SEQ ID NO: 809 - DNA, 327 bp, Artificial Sequence; identical to SEQ ID NO: 793
  Description of Artificial Sequence: Synthetic Light chain variable region nucleic acid sequence

SEQ ID NO: 810 - protein, 109 aa, Artificial Sequence; identical to SEQ ID NO: 794
  Description of Artificial Sequence: Synthetic Light chain variable region amino acid sequence

SEQ ID NO: 811 - protein, 14 aa, Artificial Sequence
  Description of Artificial Sequence: Synthetic Light chain variable region CDR L1 amino acid sequence
GSSTGAVTTSNYAN

SEQ ID NO: 812 - DNA, 42 bp, Artificial Sequence; identical to SEQ ID NO: 204
  Description of Artificial Sequence: Synthetic Light chain variable region CDR L1 nucleic acid sequence

SEQ ID NO: 813 - protein, 7 aa, Artificial Sequence
  Description of Artificial Sequence: Synthetic Light chain variable region CDR L2 amino acid sequence
GTDKRAP

SEQ ID NO: 814 - DNA, 21 bp, Artificial Sequence
  Description of Artificial Sequence: Synthetic Light chain variable region CDR L2 nucleic acid sequence
ggcacagacaagcgcgctcct

SEQ ID NO: 815 - protein, 9 aa, Artificial Sequence
  Description of Artificial Sequence: Synthetic Light chain variable region CDR L3 amino acid sequence
ALWYSNHWV

SEQ ID NO: 816 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 817 - DNA, 375 bp, Artificial Sequence; identical to SEQ ID NO: 785
  Description of Artificial Sequence: Synthetic Heavy chain variable region nucleic acid sequence

SEQ ID NO: 818 - protein, 125 aa, Artificial Sequence; identical to SEQ ID NO: 786
  Description of Artificial Sequence: Synthetic Heavy chain variable region amino acid sequence

SEQ ID NO: 819 - protein, 9 aa, Artificial Sequence
  Description of Artificial Sequence: Synthetic Heavy chain variable region CDR H1 amino acid sequence
FTFDTYAMN

SEQ ID NO: 820 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 821 - protein, 19 aa, Artificial Sequence
  Description of Artificial Sequence: Synthetic Heavy chain variable region CDR H2 amino acid sequence
RIRSKYNNYATYYADSVKD

SEQ ID NO: 822 - DNA, 57 bp, Artificial Sequence; identical to SEQ ID NO: 6
  Description of Artificial Sequence: Synthetic Heavy chain variable region CDR H2 nucleic acid sequence

SEQ ID NO: 823 - protein, 16 aa, Artificial Sequence
  Description of Artificial Sequence: Synthetic Heavy chain variable region CDR H3 amino acid sequence
VRHGNFGNGYVSWFAH

SEQ ID NO: 824 - DNA, 48 bp, Artificial Sequence; identical to SEQ ID NO: 24
  Description of Artificial Sequence: Synthetic Heavy chain variable region CDR H3 nucleic acid sequence

SEQ ID NO: 825 - DNA, 327 bp, Artificial Sequence; identical to SEQ ID NO: 793
  Description of Artificial Sequence: Synthetic Light chain variable region nucleic acid sequence

SEQ ID NO: 826 - protein, 109 aa, Artificial Sequence; identical to SEQ ID NO: 794
  Description of Artificial Sequence: Synthetic Light chain variable region amino acid sequence

SEQ ID NO: 827 - protein, 14 aa, Artificial Sequence
  Description of Artificial Sequence: Synthetic Light chain variable region CDR L1 amino acid sequence
GSSTGAVTTSNYAN

SEQ ID NO: 828 - DNA, 42 bp, Artificial Sequence; identical to SEQ ID NO: 204
  Description of Artificial Sequence: Synthetic Light chain variable region CDR L1 nucleic acid sequence

SEQ ID NO: 829 - protein, 7 aa, Artificial Sequence
  Description of Artificial Sequence: Synthetic Light chain variable region CDR L2 amino acid sequence
GTDKRAP

SEQ ID NO: 830 - DNA, 21 bp, Artificial Sequence
  Description of Artificial Sequence: Synthetic Light chain variable region CDR L2 nucleic acid sequence
ggcacagacaagcgcgctcct

SEQ ID NO: 831 - protein, 9 aa, Artificial Sequence
  Description of Artificial Sequence: Synthetic Light chain variable region CDR L3 amino acid sequence
ALWYSNHWV

SEQ ID NO: 832 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 833 - DNA, 375 bp, Artificial Sequence; identical to SEQ ID NO: 785
  Description of Artificial Sequence: Synthetic Heavy chain variable region nucleic acid sequence

SEQ ID NO: 834 - protein, 125 aa, Artificial Sequence; identical to SEQ ID NO: 786
  Description of Artificial Sequence: Synthetic Heavy chain variable region amino acid sequence

SEQ ID NO: 835 - protein, 9 aa, Artificial Sequence
  Description of Artificial Sequence: Synthetic Heavy chain variable region CDR H1 amino acid sequence
FTFDTYAMN

SEQ ID NO: 836 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 837 - protein, 19 aa, Artificial Sequence
  Description of Artificial Sequence: Synthetic Heavy chain variable region CDR H2 amino acid sequence
RIRSKYNNYATYYADSVKD

SEQ ID NO: 838 - DNA, 57 bp, Artificial Sequence; identical to SEQ ID NO: 6
  Description of Artificial Sequence: Synthetic Heavy chain variable region CDR H2 nucleic acid sequence

SEQ ID NO: 839 - protein, 16 aa, Artificial Sequence
  Description of Artificial Sequence: Synthetic Heavy chain variable region CDR H3 amino acid sequence
VRHGNFGNGYVSWFAH

SEQ ID NO: 840 - DNA, 48 bp, Artificial Sequence; identical to SEQ ID NO: 24
  Description of Artificial Sequence: Synthetic Heavy chain variable region CDR H3 nucleic acid sequence

SEQ ID NO: 841 - DNA, 327 bp, Artificial Sequence; identical to SEQ ID NO: 793
  Description of Artificial Sequence: Synthetic Light chain variable region nucleic acid sequence

SEQ ID NO: 842 - protein, 109 aa, Artificial Sequence; identical to SEQ ID NO: 794
  Description of Artificial Sequence: Synthetic Light chain variable region amino acid sequence

SEQ ID NO: 843 - protein, 14 aa, Artificial Sequence
  Description of Artificial Sequence: Synthetic Light chain variable region CDR L1 amino acid sequence
GSSTGAVTTSNYAN

SEQ ID NO: 844 - DNA, 42 bp, Artificial Sequence; identical to SEQ ID NO: 204
  Description of Artificial Sequence: Synthetic Light chain variable region CDR L1 nucleic acid sequence

SEQ ID NO: 845 - protein, 7 aa, Artificial Sequence
  Description of Artificial Sequence: Synthetic Light chain variable region CDR L2 amino acid sequence
GTDKRAP

SEQ ID NO: 846 - DNA, 21 bp, Artificial Sequence
  Description of Artificial Sequence: Synthetic Light chain variable region CDR L2 nucleic acid sequence
ggcacagacaagcgcgctcct

SEQ ID NO: 847 - protein, 9 aa, Artificial Sequence
  Description of Artificial Sequence: Synthetic Light chain variable region CDR L3 amino acid sequence
ALWYSNHWV

SEQ ID NO: 848 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 849 - DNA, 375 bp, Artificial Sequence; identical to SEQ ID NO: 785
  Description of Artificial Sequence: Synthetic Heavy chain variable region nucleic acid sequence

SEQ ID NO: 850 - protein, 125 aa, Artificial Sequence; identical to SEQ ID NO: 786
  Description of Artificial Sequence: Synthetic Heavy chain variable region amino acid sequence

SEQ ID NO: 851 - protein, 9 aa, Artificial Sequence
  Description of Artificial Sequence: Synthetic Heavy chain variable region CDR H1 amino acid sequence
FTFDTYAMN

SEQ ID NO: 852 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 853 - protein, 19 aa, Artificial Sequence
  Description of Artificial Sequence: Synthetic Heavy chain variable region CDR H2 amino acid sequence
RIRSKYNNYATYYADSVKD

SEQ ID NO: 854 - DNA, 57 bp, Artificial Sequence; identical to SEQ ID NO: 6
  Description of Artificial Sequence: Synthetic Heavy chain variable region CDR H2 nucleic acid sequence

SEQ ID NO: 855 - protein, 16 aa, Artificial Sequence
  Description of Artificial Sequence: Synthetic Heavy chain variable region CDR H3 amino acid sequence
VRHGNFGNGYVSWFAH

SEQ ID NO: 856 - DNA, 48 bp, Artificial Sequence; identical to SEQ ID NO: 24
  Description of Artificial Sequence: Synthetic Heavy chain variable region CDR H3 nucleic acid sequence

SEQ ID NO: 857 - DNA, 327 bp, Artificial Sequence; identical to SEQ ID NO: 793
  Description of Artificial Sequence: Synthetic Light chain variable region nucleic acid sequence

SEQ ID NO: 858 - protein, 109 aa, Artificial Sequence; identical to SEQ ID NO: 794
  Description of Artificial Sequence: Synthetic Light chain variable region amino acid sequence

SEQ ID NO: 859 - protein, 14 aa, Artificial Sequence
  Description of Artificial Sequence: Synthetic Light chain variable region CDR L1 amino acid sequence
GSSTGAVTTSNYAN

SEQ ID NO: 860 - DNA, 42 bp, Artificial Sequence; identical to SEQ ID NO: 204
  Description of Artificial Sequence: Synthetic Light chain variable region CDR L1 nucleic acid sequence

SEQ ID NO: 861 - protein, 7 aa, Artificial Sequence
  Description of Artificial Sequence: Synthetic Light chain variable region CDR L2 amino acid sequence
GTDKRAP

SEQ ID NO: 862 - DNA, 21 bp, Artificial Sequence
  Description of Artificial Sequence: Synthetic Light chain variable region CDR L2 nucleic acid sequence
ggcacagacaagcgcgctcct

SEQ ID NO: 863 - protein, 9 aa, Artificial Sequence
  Description of Artificial Sequence: Synthetic Light chain variable region CDR L3 amino acid sequence
ALWYSNHWV

SEQ ID NO: 864 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 865 - DNA, 375 bp, Artificial Sequence; identical to SEQ ID NO: 785
  Description of Artificial Sequence: Synthetic Heavy chain variable region nucleic acid sequence

SEQ ID NO: 866 - protein, 125 aa, Artificial Sequence; identical to SEQ ID NO: 786
  Description of Artificial Sequence: Synthetic Heavy chain variable region amino acid sequence

SEQ ID NO: 867 - protein, 9 aa, Artificial Sequence
  Description of Artificial Sequence: Synthetic Heavy chain variable region CDR H1 amino acid sequence
FTFDTYAMN

SEQ ID NO: 868 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 869 - protein, 19 aa, Artificial Sequence
  Description of Artificial Sequence: Synthetic Heavy chain variable region CDR H2 amino acid sequence
RIRSKYNNYATYYADSVKD

SEQ ID NO: 870 - DNA, 57 bp, Artificial Sequence; identical to SEQ ID NO: 6
  Description of Artificial Sequence: Synthetic Heavy chain variable region CDR H2 nucleic acid sequence

SEQ ID NO: 871 - protein, 16 aa, Artificial Sequence
  Description of Artificial Sequence: Synthetic Heavy chain variable region CDR H3 amino acid sequence
VRHGNFGNGYVSWFAH

SEQ ID NO: 872 - DNA, 48 bp, Artificial Sequence; identical to SEQ ID NO: 24
  Description of Artificial Sequence: Synthetic Heavy chain variable region CDR H3 nucleic acid sequence

SEQ ID NO: 873 - DNA, 327 bp, Artificial Sequence; identical to SEQ ID NO: 793
  Description of Artificial Sequence: Synthetic Light chain variable region nucleic acid sequence

SEQ ID NO: 874 - protein, 109 aa, Artificial Sequence; identical to SEQ ID NO: 794
  Description of Artificial Sequence: Synthetic Light chain variable region amino acid sequence

SEQ ID NO: 875 - protein, 14 aa, Artificial Sequence
  Description of Artificial Sequence: Synthetic Light chain variable region CDR L1 amino acid sequence
GSSTGAVTTSNYAN

SEQ ID NO: 876 - DNA, 42 bp, Artificial Sequence; identical to SEQ ID NO: 204
  Description of Artificial Sequence: Synthetic Light chain variable region CDR L1 nucleic acid sequence

SEQ ID NO: 877 - protein, 7 aa, Artificial Sequence
  Description of Artificial Sequence: Synthetic Light chain variable region CDR L2 amino acid sequence
GTDKRAP

SEQ ID NO: 878 - DNA, 21 bp, Artificial Sequence
  Description of Artificial Sequence: Synthetic Light chain variable region CDR L2 nucleic acid sequence
ggcacagacaagcgcgctcct

SEQ ID NO: 879 - protein, 9 aa, Artificial Sequence
  Description of Artificial Sequence: Synthetic Light chain variable region CDR L3 amino acid sequence
ALWYSNHWV

SEQ ID NO: 880 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 881 - DNA, 375 bp, Artificial Sequence; identical to SEQ ID NO: 785
  Description of Artificial Sequence: Synthetic Heavy chain variable region nucleic acid sequence

SEQ ID NO: 882 - protein, 125 aa, Artificial Sequence; identical to SEQ ID NO: 786
  Description of Artificial Sequence: Synthetic Heavy chain variable region amino acid sequence

SEQ ID NO: 883 - protein, 9 aa, Artificial Sequence
  Description of Artificial Sequence: Synthetic Heavy chain variable region CDR H1 amino acid sequence
FTFDTYAMN

SEQ ID NO: 884 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 885 - protein, 19 aa, Artificial Sequence
  Description of Artificial Sequence: Synthetic Heavy chain variable region CDR H2 amino acid sequence
RIRSKYNNYATYYADSVKD

SEQ ID NO: 886 - DNA, 57 bp, Artificial Sequence; identical to SEQ ID NO: 6
  Description of Artificial Sequence: Synthetic Heavy chain variable region CDR H2 nucleic acid sequence

SEQ ID NO: 887 - protein, 16 aa, Artificial Sequence
  Description of Artificial Sequence: Synthetic Heavy chain variable region CDR H3 amino acid sequence
VRHGNFGNGYVSWFAH

SEQ ID NO: 888 - DNA, 48 bp, Artificial Sequence; identical to SEQ ID NO: 24
  Description of Artificial Sequence: Synthetic Heavy chain variable region CDR H3 nucleic acid sequence

SEQ ID NO: 889 - DNA, 327 bp, Artificial Sequence; identical to SEQ ID NO: 793
  Description of Artificial Sequence: Synthetic Light chain variable region nucleic acid sequence

SEQ ID NO: 890 - protein, 109 aa, Artificial Sequence; identical to SEQ ID NO: 794
  Description of Artificial Sequence: Synthetic Light chain variable region amino acid sequence

SEQ ID NO: 891 - protein, 14 aa, Artificial Sequence
  Description of Artificial Sequence: Synthetic Light chain variable region CDR L1 amino acid sequence
GSSTGAVTTSNYAN

SEQ ID NO: 892 - DNA, 42 bp, Artificial Sequence; identical to SEQ ID NO: 204
  Description of Artificial Sequence: Synthetic Light chain variable region CDR L1 nucleic acid sequence

SEQ ID NO: 893 - protein, 7 aa, Artificial Sequence
  Description of Artificial Sequence: Synthetic Light chain variable region CDR L2 amino acid sequence
GTDKRAP

SEQ ID NO: 894 - DNA, 21 bp, Artificial Sequence
  Description of Artificial Sequence: Synthetic Light chain variable region CDR L2 nucleic acid sequence
ggcacagacaagcgcgctcct

SEQ ID NO: 895 - protein, 9 aa, Artificial Sequence
  Description of Artificial Sequence: Synthetic Light chain variable region CDR L3 amino acid sequence
ALWYSNHWV

SEQ ID NO: 896 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 897 - DNA, 375 bp, Artificial Sequence; identical to SEQ ID NO: 785
  Description of Artificial Sequence: Synthetic Heavy chain variable region nucleic acid sequence

SEQ ID NO: 898 - protein, 125 aa, Artificial Sequence; identical to SEQ ID NO: 786
  Description of Artificial Sequence: Synthetic Heavy chain variable region amino acid sequence

SEQ ID NO: 899 - protein, 9 aa, Artificial Sequence
  Description of Artificial Sequence: Synthetic Heavy chain variable region CDR H1 amino acid sequence
FTFDTYAMN

SEQ ID NO: 900 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 901 - protein, 19 aa, Artificial Sequence
  Description of Artificial Sequence: Synthetic Heavy chain variable region CDR H2 amino acid sequence
RIRSKYNNYATYYADSVKD

SEQ ID NO: 902 - DNA, 57 bp, Artificial Sequence; identical to SEQ ID NO: 6
  Description of Artificial Sequence: Synthetic Heavy chain variable region CDR H2 nucleic acid sequence

SEQ ID NO: 903 - protein, 16 aa, Artificial Sequence
  Description of Artificial Sequence: Synthetic Heavy chain variable region CDR H3 amino acid sequence
VRHGNFGNGYVSWFAH

SEQ ID NO: 904 - DNA, 48 bp, Artificial Sequence; identical to SEQ ID NO: 24
  Description of Artificial Sequence: Synthetic Heavy chain variable region CDR H3 nucleic acid sequence

SEQ ID NO: 905 - DNA, 327 bp, Artificial Sequence; identical to SEQ ID NO: 793
  Description of Artificial Sequence: Synthetic Light chain variable region nucleic acid sequence

SEQ ID NO: 906 - protein, 109 aa, Artificial Sequence; identical to SEQ ID NO: 794
  Description of Artificial Sequence: Synthetic Light chain variable region amino acid sequence

SEQ ID NO: 907 - protein, 14 aa, Artificial Sequence
  Description of Artificial Sequence: Synthetic Light chain variable region CDR L1 amino acid sequence
GSSTGAVTTSNYAN

SEQ ID NO: 908 - DNA, 42 bp, Artificial Sequence; identical to SEQ ID NO: 204
  Description of Artificial Sequence: Synthetic Light chain variable region CDR L1 nucleic acid sequence

SEQ ID NO: 909 - protein, 7 aa, Artificial Sequence
  Description of Artificial Sequence: Synthetic Light chain variable region CDR L2 amino acid sequence
GTDKRAP

SEQ ID NO: 910 - DNA, 21 bp, Artificial Sequence
  Description of Artificial Sequence: Synthetic Light chain variable region CDR L2 nucleic acid sequence
ggcacagacaagcgcgctcct

SEQ ID NO: 911 - protein, 9 aa, Artificial Sequence
  Description of Artificial Sequence: Synthetic Light chain variable region CDR L3 amino acid sequence
ALWYSNHWV

SEQ ID NO: 912 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 913 - DNA, 375 bp, Artificial Sequence; identical to SEQ ID NO: 785
  Description of Artificial Sequence: Synthetic Heavy chain variable region nucleic acid sequence

SEQ ID NO: 914 - protein, 125 aa, Artificial Sequence; identical to SEQ ID NO: 786
  Description of Artificial Sequence: Synthetic Heavy chain variable region amino acid sequence

SEQ ID NO: 915 - protein, 9 aa, Artificial Sequence
  Description of Artificial Sequence: Synthetic Heavy chain variable region CDR H1 amino acid sequence
FTFDTYAMN

SEQ ID NO: 916 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 917 - protein, 19 aa, Artificial Sequence
  Description of Artificial Sequence: Synthetic Heavy chain variable region CDR H2 amino acid sequence
RIRSKYNNYATYYADSVKD

SEQ ID NO: 918 - DNA, 57 bp, Artificial Sequence; identical to SEQ ID NO: 6
  Description of Artificial Sequence: Synthetic Heavy chain variable region CDR H2 nucleic acid sequence

SEQ ID NO: 919 - protein, 16 aa, Artificial Sequence
  Description of Artificial Sequence: Synthetic Heavy chain variable region CDR H3 amino acid sequence
VRHGNFGNGYVSWFAH

SEQ ID NO: 920 - DNA, 48 bp, Artificial Sequence; identical to SEQ ID NO: 24
  Description of Artificial Sequence: Synthetic Heavy chain variable region CDR H3 nucleic acid sequence

SEQ ID NO: 921 - DNA, 327 bp, Artificial Sequence; identical to SEQ ID NO: 793
  Description of Artificial Sequence: Synthetic Light chain variable region nucleic acid sequence

SEQ ID NO: 922 - protein, 109 aa, Artificial Sequence; identical to SEQ ID NO: 794
  Description of Artificial Sequence: Synthetic Light chain variable region amino acid sequence

SEQ ID NO: 923 - protein, 14 aa, Artificial Sequence
  Description of Artificial Sequence: Synthetic Light chain variable region CDR L1 amino acid sequence
GSSTGAVTTSNYAN

SEQ ID NO: 924 - DNA, 42 bp, Artificial Sequence; identical to SEQ ID NO: 204
  Description of Artificial Sequence: Synthetic Light chain variable region CDR L1 nucleic acid sequence

SEQ ID NO: 925 - protein, 7 aa, Artificial Sequence
  Description of Artificial Sequence: Synthetic Light chain variable region CDR L2 amino acid sequence
GTDKRAP

SEQ ID NO: 926 - DNA, 21 bp, Artificial Sequence
  Description of Artificial Sequence: Synthetic Light chain variable region CDR L2 nucleic acid sequence
ggcacagacaagcgcgctcct

SEQ ID NO: 927 - protein, 9 aa, Artificial Sequence
  Description of Artificial Sequence: Synthetic Light chain variable region CDR L3 amino acid sequence
ALWYSNHWV

SEQ ID NO: 928 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 929 - DNA, 375 bp, Artificial Sequence; identical to SEQ ID NO: 785
  Description of Artificial Sequence: Synthetic Heavy chain variable region nucleic acid sequence

SEQ ID NO: 930 - protein, 125 aa, Artificial Sequence; identical to SEQ ID NO: 786
  Description of Artificial Sequence: Synthetic Heavy chain variable region amino acid sequence

SEQ ID NO: 931 - protein, 9 aa, Artificial Sequence
  Description of Artificial Sequence: Synthetic Heavy chain variable region CDR H1 amino acid sequence
FTFDTYAMN

SEQ ID NO: 932 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 933 - protein, 19 aa, Artificial Sequence
  Description of Artificial Sequence: Synthetic Heavy chain variable region CDR H2 amino acid sequence
RIRSKYNNYATYYADSVKD

SEQ ID NO: 934 - DNA, 57 bp, Artificial Sequence; identical to SEQ ID NO: 6
  Description of Artificial Sequence: Synthetic Heavy chain variable region CDR H2 nucleic acid sequence

SEQ ID NO: 935 - protein, 16 aa, Artificial Sequence
  Description of Artificial Sequence: Synthetic Heavy chain variable region CDR H3 amino acid sequence
VRHGNFGNGYVSWFAH

SEQ ID NO: 936 - DNA, 48 bp, Artificial Sequence; identical to SEQ ID NO: 24
  Description of Artificial Sequence: Synthetic Heavy chain variable region CDR H3 nucleic acid sequence

SEQ ID NO: 937 - DNA, 327 bp, Artificial Sequence; identical to SEQ ID NO: 793
  Description of Artificial Sequence: Synthetic Light chain variable region nucleic acid sequence

SEQ ID NO: 938 - protein, 109 aa, Artificial Sequence; identical to SEQ ID NO: 794
  Description of Artificial Sequence: Synthetic Light chain variable region amino acid sequence

SEQ ID NO: 939 - protein, 14 aa, Artificial Sequence
  Description of Artificial Sequence: Synthetic Light chain variable region CDR L1 amino acid sequence
GSSTGAVTTSNYAN

SEQ ID NO: 940 - DNA, 42 bp, Artificial Sequence; identical to SEQ ID NO: 204
  Description of Artificial Sequence: Synthetic Light chain variable region CDR L1 nucleic acid sequence

SEQ ID NO: 941 - protein, 7 aa, Artificial Sequence
  Description of Artificial Sequence: Synthetic Light chain variable region CDR L2 amino acid sequence
GTDKRAP

SEQ ID NO: 942 - DNA, 21 bp, Artificial Sequence
  Description of Artificial Sequence: Synthetic Light chain variable region CDR L2 nucleic acid sequence
ggcacagacaagcgcgctcct

SEQ ID NO: 943 - protein, 9 aa, Artificial Sequence
  Description of Artificial Sequence: Synthetic Light chain variable region CDR L3 amino acid sequence
ALWYSNHWV

SEQ ID NO: 944 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 945 - DNA, 375 bp, Artificial Sequence; identical to SEQ ID NO: 785
  Description of Artificial Sequence: Synthetic Heavy chain variable region nucleic acid sequence

SEQ ID NO: 946 - protein, 125 aa, Artificial Sequence; identical to SEQ ID NO: 786
  Description of Artificial Sequence: Synthetic Heavy chain variable region amino acid sequence

SEQ ID NO: 947 - protein, 9 aa, Artificial Sequence
  Description of Artificial Sequence: Synthetic Heavy chain variable region CDR H1 amino acid sequence
FTFDTYAMN

SEQ ID NO: 948 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 949 - protein, 19 aa, Artificial Sequence
  Description of Artificial Sequence: Synthetic Heavy chain variable region CDR H2 amino acid sequence
RIRSKYNNYATYYADSVKD

SEQ ID NO: 950 - DNA, 57 bp, Artificial Sequence; identical to SEQ ID NO: 6
  Description of Artificial Sequence: Synthetic Heavy chain variable region CDR H2 nucleic acid sequence

SEQ ID NO: 951 - protein, 16 aa, Artificial Sequence
  Description of Artificial Sequence: Synthetic Heavy chain variable region CDR H3 amino acid sequence
VRHGNFGNGYVSWFAH

SEQ ID NO: 952 - DNA, 48 bp, Artificial Sequence; identical to SEQ ID NO: 24
  Description of Artificial Sequence: Synthetic Heavy chain variable region CDR H3 nucleic acid sequence

SEQ ID NO: 953 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatctcttctctggctccctgcttggggacaaagctgccctcaccatcacgggggcccaggcagaggatgaagctgattattactgtgcgctgtggtacagtaaccattgggtgttcggctgtgggaccaagctgaccgtccta

SEQ ID NO: 954 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDLFSGSLLGDKAALTITGAQAEDEADYYCALWYSNHWVFGCGTKLTVL

SEQ ID NO: 955 - protein, 14 aa, Artificial Sequence
  Description of Artificial Sequence: Synthetic Light chain variable region CDR L1 amino acid sequence
GSSTGAVTTSNYAN

SEQ ID NO: 956 - DNA, 42 bp, Artificial Sequence; identical to SEQ ID NO: 204
  Description of Artificial Sequence: Synthetic Light chain variable region CDR L1 nucleic acid sequence

SEQ ID NO: 957 - protein, 7 aa, Artificial Sequence
  Description of Artificial Sequence: Synthetic Light chain variable region CDR L2 amino acid sequence
GTDKRAP

SEQ ID NO: 958 - DNA, 21 bp, Artificial Sequence
  Description of Artificial Sequence: Synthetic Light chain variable region CDR L2 nucleic acid sequence
ggcacagacaagcgcgctcct

SEQ ID NO: 959 - protein, 9 aa, Artificial Sequence
  Description of Artificial Sequence: Synthetic Light chain variable region CDR L3 amino acid sequence
ALWYSNHWV

SEQ ID NO: 960 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 961 - DNA, 375 bp, Artificial Sequence; identical to SEQ ID NO: 785
  Description of Artificial Sequence: Synthetic Heavy chain variable region nucleic acid sequence

SEQ ID NO: 962 - protein, 125 aa, Artificial Sequence; identical to SEQ ID NO: 786
  Description of Artificial Sequence: Synthetic Heavy chain variable region amino acid sequence

SEQ ID NO: 963 - protein, 9 aa, Artificial Sequence
  Description of Artificial Sequence: Synthetic Heavy chain variable region CDR H1 amino acid sequence
FTFDTYAMN

SEQ ID NO: 964 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 965 - protein, 19 aa, Artificial Sequence
  Description of Artificial Sequence: Synthetic Heavy chain variable region CDR H2 amino acid sequence
RIRSKYNNYATYYADSVKD

SEQ ID NO: 966 - DNA, 57 bp, Artificial Sequence; identical to SEQ ID NO: 6
  Description of Artificial Sequence: Synthetic Heavy chain variable region CDR H2 nucleic acid sequence

SEQ ID NO: 967 - protein, 16 aa, Artificial Sequence
  Description of Artificial Sequence: Synthetic Heavy chain variable region CDR H3 amino acid sequence
VRHGNFGNGYVSWFAH

SEQ ID NO: 968 - DNA, 48 bp, Artificial Sequence; identical to SEQ ID NO: 24
  Description of Artificial Sequence: Synthetic Heavy chain variable region CDR H3 nucleic acid sequence

SEQ ID NO: 969 - DNA, 327 bp, Artificial Sequence; identical to SEQ ID NO: 793
  Description of Artificial Sequence: Synthetic Light chain variable region nucleic acid sequence

SEQ ID NO: 970 - protein, 109 aa, Artificial Sequence; identical to SEQ ID NO: 794
  Description of Artificial Sequence: Synthetic Light chain variable region amino acid sequence

SEQ ID NO: 971 - protein, 14 aa, Artificial Sequence
  Description of Artificial Sequence: Synthetic Light chain variable region CDR L1 amino acid sequence
GSSTGAVTTSNYAN

SEQ ID NO: 972 - DNA, 42 bp, Artificial Sequence; identical to SEQ ID NO: 204
  Description of Artificial Sequence: Synthetic Light chain variable region CDR L1 nucleic acid sequence

SEQ ID NO: 973 - protein, 7 aa, Artificial Sequence
  Description of Artificial Sequence: Synthetic Light chain variable region CDR L2 amino acid sequence
GTDKRAP

SEQ ID NO: 974 - DNA, 21 bp, Artificial Sequence
  Description of Artificial Sequence: Synthetic Light chain variable region CDR L2 nucleic acid sequence
ggcacagacaagcgcgctcct

SEQ ID NO: 975 - protein, 9 aa, Artificial Sequence
  Description of Artificial Sequence: Synthetic Light chain variable region CDR L3 amino acid sequence
ALWYSNHWV

SEQ ID NO: 976 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 977 - DNA, 375 bp, Artificial Sequence; identical to SEQ ID NO: 785
  Description of Artificial Sequence: Synthetic Heavy chain variable region nucleic acid sequence

SEQ ID NO: 978 - protein, 125 aa, Artificial Sequence; identical to SEQ ID NO: 786
  Description of Artificial Sequence: Synthetic Heavy chain variable region amino acid sequence

SEQ ID NO: 979 - protein, 9 aa, Artificial Sequence
  Description of Artificial Sequence: Synthetic Heavy chain variable region CDR H1 amino acid sequence
FTFDTYAMN

SEQ ID NO: 980 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 981 - protein, 19 aa, Artificial Sequence
  Description of Artificial Sequence: Synthetic Heavy chain variable region CDR H2 amino acid sequence
RIRSKYNNYATYYADSVKD

SEQ ID NO: 982 - DNA, 57 bp, Artificial Sequence; identical to SEQ ID NO: 6
  Description of Artificial Sequence: Synthetic Heavy chain variable region CDR H2 nucleic acid sequence

SEQ ID NO: 983 - protein, 16 aa, Artificial Sequence
  Description of Artificial Sequence: Synthetic Heavy chain variable region CDR H3 amino acid sequence
VRHGNFGNGYVSWFAH

SEQ ID NO: 984 - DNA, 48 bp, Artificial Sequence; identical to SEQ ID NO: 24
  Description of Artificial Sequence: Synthetic Heavy chain variable region CDR H3 nucleic acid sequence

SEQ ID NO: 985 - DNA, 327 bp, Artificial Sequence; identical to SEQ ID NO: 793
  Description of Artificial Sequence: Synthetic Light chain variable region nucleic acid sequence

SEQ ID NO: 986 - protein, 109 aa, Artificial Sequence; identical to SEQ ID NO: 794
  Description of Artificial Sequence: Synthetic Light chain variable region amino acid sequence

SEQ ID NO: 987 - protein, 14 aa, Artificial Sequence
  Description of Artificial Sequence: Synthetic Light chain variable region CDR L1 amino acid sequence
GSSTGAVTTSNYAN

SEQ ID NO: 988 - DNA, 42 bp, Artificial Sequence; identical to SEQ ID NO: 204
  Description of Artificial Sequence: Synthetic Light chain variable region CDR L1 nucleic acid sequence

SEQ ID NO: 989 - protein, 7 aa, Artificial Sequence
  Description of Artificial Sequence: Synthetic Light chain variable region CDR L2 amino acid sequence
GTDKRAP

SEQ ID NO: 990 - DNA, 21 bp, Artificial Sequence
  Description of Artificial Sequence: Synthetic Light chain variable region CDR L2 nucleic acid sequence
ggcacagacaagcgcgctcct

SEQ ID NO: 991 - protein, 9 aa, Artificial Sequence
  Description of Artificial Sequence: Synthetic Light chain variable region CDR L3 amino acid sequence
ALWYSNHWV

SEQ ID NO: 992 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 993 - DNA, 375 bp, Artificial Sequence; identical to SEQ ID NO: 785
  Description of Artificial Sequence: Synthetic Heavy chain variable region nucleic acid sequence

SEQ ID NO: 994 - protein, 125 aa, Artificial Sequence; identical to SEQ ID NO: 786
  Description of Artificial Sequence: Synthetic Heavy chain variable region amino acid sequence

SEQ ID NO: 995 - protein, 9 aa, Artificial Sequence
  Description of Artificial Sequence: Synthetic Heavy chain variable region CDR H1 amino acid sequence
FTFDTYAMN

SEQ ID NO: 996 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 997 - protein, 19 aa, Artificial Sequence
  Description of Artificial Sequence: Synthetic Heavy chain variable region CDR H2 amino acid sequence
RIRSKYNNYATYYADSVKD

SEQ ID NO: 998 - DNA, 57 bp, Artificial Sequence; identical to SEQ ID NO: 6
  Description of Artificial Sequence: Synthetic Heavy chain variable region CDR H2 nucleic acid sequence

SEQ ID NO: 999 - protein, 16 aa, Artificial Sequence
  Description of Artificial Sequence: Synthetic Heavy chain variable region CDR H3 amino acid sequence
VRHGNFGNGYVSWFAH

SEQ ID NO: 1000 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1001 - DNA, 327 bp, Artificial Sequence; identical to SEQ ID NO: 793
  Description of Artificial Sequence: Synthetic Light chain variable region nucleic acid sequence

SEQ ID NO: 1002 - protein, 109 aa, Artificial Sequence; identical to SEQ ID NO: 794
  Description of Artificial Sequence: Synthetic Light chain variable region amino acid sequence

SEQ ID NO: 1003 - protein, 14 aa, Artificial Sequence
  Description of Artificial Sequence: Synthetic Light chain variable region CDR L1 amino acid sequence
GSSTGAVTTSNYAN

SEQ ID NO: 1004 - DNA, 42 bp, Artificial Sequence; identical to SEQ ID NO: 204
  Description of Artificial Sequence: Synthetic Light chain variable region CDR L1 nucleic acid sequence

SEQ ID NO: 1005 - protein, 7 aa, Artificial Sequence
  Description of Artificial Sequence: Synthetic Light chain variable region CDR L2 amino acid sequence
GTDKRAP

SEQ ID NO: 1006 - DNA, 21 bp, Artificial Sequence
  Description of Artificial Sequence: Synthetic Light chain variable region CDR L2 nucleic acid sequence
ggcacagacaagcgcgctcct

SEQ ID NO: 1007 - protein, 9 aa, Artificial Sequence
  Description of Artificial Sequence: Synthetic Light chain variable region CDR L3 amino acid sequence
ALWYSNHWV

SEQ ID NO: 1008 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1009 - DNA, 375 bp, Artificial Sequence; identical to SEQ ID NO: 785
  Description of Artificial Sequence: Synthetic Heavy chain variable region nucleic acid sequence

SEQ ID NO: 1010 - protein, 125 aa, Artificial Sequence; identical to SEQ ID NO: 786
  Description of Artificial Sequence: Synthetic Heavy chain variable region amino acid sequence

SEQ ID NO: 1011 - protein, 9 aa, Artificial Sequence
  Description of Artificial Sequence: Synthetic Heavy chain variable region CDR H1 amino acid sequence
FTFDTYAMN

SEQ ID NO: 1012 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1013 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1014 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1015 - protein, 16 aa, Artificial Sequence
  Description of Artificial Sequence: Synthetic Heavy chain variable region CDR H3 amino acid sequence
VRHGNFGNGYVSWFAH

SEQ ID NO: 1016 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1017 - DNA, 327 bp, Artificial Sequence; identical to SEQ ID NO: 793
  Description of Artificial Sequence: Synthetic Light chain variable region nucleic acid sequence

SEQ ID NO: 1018 - protein, 109 aa, Artificial Sequence; identical to SEQ ID NO: 794
  Description of Artificial Sequence: Synthetic Light chain variable region amino acid sequence

SEQ ID NO: 1019 - protein, 14 aa, Artificial Sequence
  Description of Artificial Sequence: Synthetic Light chain variable region CDR L1 amino acid sequence
GSSTGAVTTSNYAN

SEQ ID NO: 1020 - DNA, 42 bp, Artificial Sequence; identical to SEQ ID NO: 204
  Description of Artificial Sequence: Synthetic Light chain variable region CDR L1 nucleic acid sequence

SEQ ID NO: 1021 - protein, 7 aa, Artificial Sequence
  Description of Artificial Sequence: Synthetic Light chain variable region CDR L2 amino acid sequence
GTDKRAP

SEQ ID NO: 1022 - DNA, 21 bp, Artificial Sequence
  Description of Artificial Sequence: Synthetic Light chain variable region CDR L2 nucleic acid sequence
ggcacagacaagcgcgctcct

SEQ ID NO: 1023 - protein, 9 aa, Artificial Sequence
  Description of Artificial Sequence: Synthetic Light chain variable region CDR L3 amino acid sequence
ALWYSNHWV

SEQ ID NO: 1024 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1025 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggggatgtctggagtgggtcgcaaggattagatccaagtataacaattacgctacatactacgcagactccgtgaaggatcggttcaccatctccagagacgattccaagagcacgctgtatctgcaaatgaacagcctgagagccgaggacacggcggtgtactactgcgtcaggcacggtaacttcgggaacggttacgtatcctggtttgctcattggggccaaggaaccctggtcaccgtctcctca

SEQ ID NO: 1026 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGGCLEWVARIRSKYNNYATYYADSVKDRFTISRDDSKSTLYLQMNSLRAEDTAVYYCVRHGNFGNGYVSWFAHWGQGTLVTVSS

SEQ ID NO: 1027 - protein, 9 aa, Artificial Sequence
  Description of Artificial Sequence: Synthetic Heavy chain variable region CDR H1 amino acid sequence
FTFDTYAMN

SEQ ID NO: 1028 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1029 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1030 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1031 - protein, 16 aa, Artificial Sequence
  Description of Artificial Sequence: Synthetic Heavy chain variable region CDR H3 amino acid sequence
VRHGNFGNGYVSWFAH

SEQ ID NO: 1032 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1033 - DNA, 327 bp, Artificial Sequence; identical to SEQ ID NO: 793
  Description of Artificial Sequence: Synthetic Light chain variable region nucleic acid sequence

SEQ ID NO: 1034 - protein, 109 aa, Artificial Sequence; identical to SEQ ID NO: 794
  Description of Artificial Sequence: Synthetic Light chain variable region amino acid sequence

SEQ ID NO: 1035 - protein, 14 aa, Artificial Sequence
  Description of Artificial Sequence: Synthetic Light chain variable region CDR L1 amino acid sequence
GSSTGAVTTSNYAN

SEQ ID NO: 1036 - DNA, 42 bp, Artificial Sequence; identical to SEQ ID NO: 204
  Description of Artificial Sequence: Synthetic Light chain variable region CDR L1 nucleic acid sequence

SEQ ID NO: 1037 - protein, 7 aa, Artificial Sequence
  Description of Artificial Sequence: Synthetic Light chain variable region CDR L2 amino acid sequence
GTDKRAP

SEQ ID NO: 1038 - DNA, 21 bp, Artificial Sequence
  Description of Artificial Sequence: Synthetic Light chain variable region CDR L2 nucleic acid sequence
ggcacagacaagcgcgctcct

SEQ ID NO: 1039 - protein, 9 aa, Artificial Sequence
  Description of Artificial Sequence: Synthetic Light chain variable region CDR L3 amino acid sequence
ALWYSNHWV

SEQ ID NO: 1040 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1041 - DNA, 375 bp, Artificial Sequence; identical to SEQ ID NO: 1025
  Description of Artificial Sequence: Synthetic Heavy chain variable region nucleic acid sequence

SEQ ID NO: 1042 - protein, 125 aa, Artificial Sequence; identical to SEQ ID NO: 1026
  Description of Artificial Sequence: Synthetic Heavy chain variable region amino acid sequence

SEQ ID NO: 1043 - protein, 9 aa, Artificial Sequence
  Description of Artificial Sequence: Synthetic Heavy chain variable region CDR H1 amino acid sequence
FTFDTYAMN

SEQ ID NO: 1044 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1045 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1046 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1047 - protein, 16 aa, Artificial Sequence
  Description of Artificial Sequence: Synthetic Heavy chain variable region CDR H3 amino acid sequence
VRHGNFGNGYVSWFAH

SEQ ID NO: 1048 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1049 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccttgatctcttctctggctccctgcttggggacaaagctgccctcaccatcacgggggcccaggcagaggatgaagctgattattactgtgcgctgtggtacagtaaccattgggtgttcggctgtgggaccaagctgaccgtccta

SEQ ID NO: 1050 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVLDLFSGSLLGDKAALTITGAQAEDEADYYCALWYSNHWVFGCGTKLTVL

SEQ ID NO: 1051 - protein, 14 aa, Artificial Sequence
  Description of Artificial Sequence: Synthetic Light chain variable region CDR L1 amino acid sequence
GSSTGAVTTSNYAN

SEQ ID NO: 1052 - DNA, 42 bp, Artificial Sequence; identical to SEQ ID NO: 204
  Description of Artificial Sequence: Synthetic Light chain variable region CDR L1 nucleic acid sequence

SEQ ID NO: 1053 - protein, 7 aa, Artificial Sequence
  Description of Artificial Sequence: Synthetic Light chain variable region CDR L2 amino acid sequence
GTDKRAP

SEQ ID NO: 1054 - DNA, 21 bp, Artificial Sequence
  Description of Artificial Sequence: Synthetic Light chain variable region CDR L2 nucleic acid sequence
ggcacagacaagcgcgctcct

SEQ ID NO: 1055 - protein, 9 aa, Artificial Sequence
  Description of Artificial Sequence: Synthetic Light chain variable region CDR L3 amino acid sequence
ALWYSNHWV

SEQ ID NO: 1056 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1057 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttccagggtggttacgtatcctggtttgctcattggggccaaggaaccctggtcaccgtctcctca

SEQ ID NO: 1058 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHGNFQGGYVSWFAHWGQGTLVTVSS

SEQ ID NO: 1059 - protein, 9 aa, Artificial Sequence
  Description of Artificial Sequence: Synthetic Heavy chain variable region CDR H1 amino acid sequence
FTFDTYAMN

SEQ ID NO: 1060 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1061 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1062 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1063 - protein, 16 aa, Artificial Sequence
  Description of Artificial Sequence: Synthetic Heavy chain variable region CDR H3 amino acid sequence
VRHGNFQGGYVSWFAH

SEQ ID NO: 1064 - DNA, 48 bp, Artificial Sequence
  Description of Artificial Sequence: Synthetic Heavy chain variable region CDR H3 nucleic acid sequence
gtcaggcacggtaacttccagggtggttacgtatcctggtttgctcat

SEQ ID NO: 1065 - DNA, 327 bp, Artificial Sequence; identical to SEQ ID NO: 345
  Description of Artificial Sequence: Synthetic Light chain variable region nucleic acid sequence

SEQ ID NO: 1066 - protein, 109 aa, Artificial Sequence; identical to SEQ ID NO: 346
  Description of Artificial Sequence: Synthetic Light chain variable region amino acid sequence

SEQ ID NO: 1067 - protein, 14 aa, Artificial Sequence
  Description of Artificial Sequence: Synthetic Light chain variable region CDR L1 amino acid sequence
GSSTGAVTTSNYAN

SEQ ID NO: 1068 - DNA, 42 bp, Artificial Sequence; identical to SEQ ID NO: 204
  Description of Artificial Sequence: Synthetic Light chain variable region CDR L1 nucleic acid sequence

SEQ ID NO: 1069 - protein, 7 aa, Artificial Sequence
  Description of Artificial Sequence: Synthetic Light chain variable region CDR L2 amino acid sequence
GTDKRAP

SEQ ID NO: 1070 - DNA, 21 bp, Artificial Sequence
  Description of Artificial Sequence: Synthetic Light chain variable region CDR L2 nucleic acid sequence
ggcacagacaagcgcgctcct

SEQ ID NO: 1071 - protein, 9 aa, Artificial Sequence
  Description of Artificial Sequence: Synthetic Light chain variable region CDR L3 amino acid sequence
ALWYSNHWV

SEQ ID NO: 1072 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1073 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttcggggggggttacgtatcctggtttgcttggtggggccaaggaaccctggtcaccgtctcctca

SEQ ID NO: 1074 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHGNFGGGYVSWFAWWGQGTLVTVSS

SEQ ID NO: 1075 - protein, 9 aa, Artificial Sequence
  Description of Artificial Sequence: Synthetic Heavy chain variable region CDR H1 amino acid sequence
FTFDTYAMN

SEQ ID NO: 1076 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1077 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1078 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1079 - protein, 16 aa, Artificial Sequence
  Description of Artificial Sequence: Synthetic Heavy chain variable region CDR H3 amino acid sequence
VRHGNFGGGYVSWFAW

SEQ ID NO: 1080 - DNA, 48 bp, Artificial Sequence
  Description of Artificial Sequence: Synthetic Heavy chain variable region CDR H3 nucleic acid sequence
gtcaggcacggtaacttcggggggggttacgtatcctggtttgcttgg

SEQ ID NO: 1081 - DNA, 327 bp, Artificial Sequence; identical to SEQ ID NO: 345
  Description of Artificial Sequence: Synthetic Light chain variable region nucleic acid sequence

SEQ ID NO: 1082 - protein, 109 aa, Artificial Sequence; identical to SEQ ID NO: 346
  Description of Artificial Sequence: Synthetic Light chain variable region amino acid sequence

SEQ ID NO: 1083 - protein, 14 aa, Artificial Sequence
  Description of Artificial Sequence: Synthetic Light chain variable region CDR L1 amino acid sequence
GSSTGAVTTSNYAN

SEQ ID NO: 1084 - DNA, 42 bp, Artificial Sequence; identical to SEQ ID NO: 204
  Description of Artificial Sequence: Synthetic Light chain variable region CDR L1 nucleic acid sequence

SEQ ID NO: 1085 - protein, 7 aa, Artificial Sequence
  Description of Artificial Sequence: Synthetic Light chain variable region CDR L2 amino acid sequence
GTDKRAP

SEQ ID NO: 1086 - DNA, 21 bp, Artificial Sequence
  Description of Artificial Sequence: Synthetic Light chain variable region CDR L2 nucleic acid sequence
ggcacagacaagcgcgctcct

SEQ ID NO: 1087 - protein, 9 aa, Artificial Sequence
  Description of Artificial Sequence: Synthetic Light chain variable region CDR L3 amino acid sequence
ALWYSNHWV

SEQ ID NO: 1088 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1089 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacgcgaacttcggggcgggttacgtatcctggtttgctcattggggccaaggaaccctggtcaccgtctcctca

SEQ ID NO: 1090 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHANFGAGYVSWFAHWGQGTLVTVSS

SEQ ID NO: 1091 - protein, 9 aa, Artificial Sequence
  Description of Artificial Sequence: Synthetic Heavy chain variable region CDR H1 amino acid sequence
FTFDTYAMN

SEQ ID NO: 1092 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1093 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1094 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1095 - protein, 16 aa, Artificial Sequence
  Description of Artificial Sequence: Synthetic Heavy chain variable region CDR H3 amino acid sequence
VRHANFGAGYVSWFAH

SEQ ID NO: 1096 - DNA, 48 bp, Artificial Sequence
  Description of Artificial Sequence: Synthetic Heavy chain variable region CDR H3 nucleic acid sequence
gtcaggcacgcgaacttcggggcgggttacgtatcctggtttgctcat

SEQ ID NO: 1097 - DNA, 327 bp, Artificial Sequence; identical to SEQ ID NO: 345
  Description of Artificial Sequence: Synthetic Light chain variable region nucleic acid sequence

SEQ ID NO: 1098 - protein, 109 aa, Artificial Sequence; identical to SEQ ID NO: 346
  Description of Artificial Sequence: Synthetic Light chain variable region amino acid sequence

SEQ ID NO: 1099 - protein, 14 aa, Artificial Sequence
  Description of Artificial Sequence: Synthetic Light chain variable region CDR L1 amino acid sequence
GSSTGAVTTSNYAN

SEQ ID NO: 1100 - DNA, 42 bp, Artificial Sequence; identical to SEQ ID NO: 204
  Description of Artificial Sequence: Synthetic Light chain variable region CDR L1 nucleic acid sequence

SEQ ID NO: 1101 - protein, 7 aa, Artificial Sequence
  Description of Artificial Sequence: Synthetic Light chain variable region CDR L2 amino acid sequence
GTDKRAP

SEQ ID NO: 1102 - DNA, 21 bp, Artificial Sequence
  Description of Artificial Sequence: Synthetic Light chain variable region CDR L2 nucleic acid sequence
ggcacagacaagcgcgctcct

SEQ ID NO: 1103 - protein, 9 aa, Artificial Sequence
  Description of Artificial Sequence: Synthetic Light chain variable region CDR L3 amino acid sequence
ALWYSNHWV

SEQ ID NO: 1104 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1105 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttcggggaaggttacgtatcctggtttgctcattggggccaaggaaccctggtcaccgtctcctca

SEQ ID NO: 1106 - protein, 125 aa, Artificial Sequence; identical to SEQ ID NO: 482
  Description of Artificial Sequence: Synthetic Heavy chain variable region amino acid sequence

SEQ ID NO: 1107 - protein, 9 aa, Artificial Sequence
  Description of Artificial Sequence: Synthetic Heavy chain variable region CDR H1 amino acid sequence
FTFDTYAMN

SEQ ID NO: 1108 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1109 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1110 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1111 - protein, 16 aa, Artificial Sequence
  Description of Artificial Sequence: Synthetic Heavy chain variable region CDR H3 amino acid sequence
VRHGNFGEGYVSWFAH

SEQ ID NO: 1112 - DNA, 48 bp, Artificial Sequence; identical to SEQ ID NO: 472
  Description of Artificial Sequence: Synthetic Heavy chain variable region CDR H3 nucleic acid sequence

SEQ ID NO: 1113 - DNA, 327 bp, Artificial Sequence; identical to SEQ ID NO: 345
  Description of Artificial Sequence: Synthetic Light chain variable region nucleic acid sequence

SEQ ID NO: 1114 - protein, 109 aa, Artificial Sequence; identical to SEQ ID NO: 346
  Description of Artificial Sequence: Synthetic Light chain variable region amino acid sequence

SEQ ID NO: 1115 - protein, 14 aa, Artificial Sequence
  Description of Artificial Sequence: Synthetic Light chain variable region CDR L1 amino acid sequence
GSSTGAVTTSNYAN

SEQ ID NO: 1116 - DNA, 42 bp, Artificial Sequence; identical to SEQ ID NO: 204
  Description of Artificial Sequence: Synthetic Light chain variable region CDR L1 nucleic acid sequence

SEQ ID NO: 1117 - protein, 7 aa, Artificial Sequence
  Description of Artificial Sequence: Synthetic Light chain variable region CDR L2 amino acid sequence
GTDKRAP

SEQ ID NO: 1118 - DNA, 21 bp, Artificial Sequence
  Description of Artificial Sequence: Synthetic Light chain variable region CDR L2 nucleic acid sequence
ggcacagacaagcgcgctcct

SEQ ID NO: 1119 - protein, 9 aa, Artificial Sequence
  Description of Artificial Sequence: Synthetic Light chain variable region CDR L3 amino acid sequence
ALWYSNHWV

SEQ ID NO: 1120 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1121 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacgataacttcggggctggttacgtatcctggtttgctcattggggccaaggaaccctggtcaccgtctcctca

SEQ ID NO: 1122 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHDNFGAGYVSWFAHWGQGTLVTVSS

SEQ ID NO: 1123 - protein, 9 aa, Artificial Sequence
  Description of Artificial Sequence: Synthetic Heavy chain variable region CDR H1 amino acid sequence
FTFDTYAMN

SEQ ID NO: 1124 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1125 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1126 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1127 - protein, 16 aa, Artificial Sequence
  Description of Artificial Sequence: Synthetic Heavy chain variable region CDR H3 amino acid sequence
VRHDNFGAGYVSWFAH

SEQ ID NO: 1128 - DNA, 48 bp, Artificial Sequence
  Description of Artificial Sequence: Synthetic Heavy chain variable region CDR H3 nucleic acid sequence
gtcaggcacgataacttcggggctggttacgtatcctggtttgctcat

SEQ ID NO: 1129 - DNA, 327 bp, Artificial Sequence; identical to SEQ ID NO: 345
  Description of Artificial Sequence: Synthetic Light chain variable region nucleic acid sequence

SEQ ID NO: 1130 - protein, 109 aa, Artificial Sequence; identical to SEQ ID NO: 346
  Description of Artificial Sequence: Synthetic Light chain variable region amino acid sequence

SEQ ID NO: 1131 - protein, 14 aa, Artificial Sequence
  Description of Artificial Sequence: Synthetic Light chain variable region CDR L1 amino acid sequence
GSSTGAVTTSNYAN

SEQ ID NO: 1132 - DNA, 42 bp, Artificial Sequence; identical to SEQ ID NO: 204
  Description of Artificial Sequence: Synthetic Light chain variable region CDR L1 nucleic acid sequence

SEQ ID NO: 1133 - protein, 7 aa, Artificial Sequence
  Description of Artificial Sequence: Synthetic Light chain variable region CDR L2 amino acid sequence
GTDKRAP

SEQ ID NO: 1134 - DNA, 21 bp, Artificial Sequence
  Description of Artificial Sequence: Synthetic Light chain variable region CDR L2 nucleic acid sequence
ggcacagacaagcgcgctcct

SEQ ID NO: 1135 - protein, 9 aa, Artificial Sequence
  Description of Artificial Sequence: Synthetic Light chain variable region CDR L3 amino acid sequence
ALWYSNHWV

SEQ ID NO: 1136 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1137 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttcggggttggttacgtatcctggtttgcttcttggggccaaggaaccctggtcaccgtctcctca

SEQ ID NO: 1138 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHGNFGVGYVSWFASWGQGTLVTVSS

SEQ ID NO: 1139 - protein, 9 aa, Artificial Sequence
  Description of Artificial Sequence: Synthetic Heavy chain variable region CDR H1 amino acid sequence
FTFDTYAMN

SEQ ID NO: 1140 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1141 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1142 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1143 - protein, 16 aa, Artificial Sequence
  Description of Artificial Sequence: Synthetic Heavy chain variable region CDR H3 amino acid sequence
VRHGNFGVGYVSWFAS

SEQ ID NO: 1144 - DNA, 48 bp, Artificial Sequence
  Description of Artificial Sequence: Synthetic Heavy chain variable region CDR H3 nucleic acid sequence
gtcaggcacggtaacttcggggttggttacgtatcctggtttgcttct

SEQ ID NO: 1145 - DNA, 327 bp, Artificial Sequence; identical to SEQ ID NO: 345
  Description of Artificial Sequence: Synthetic Light chain variable region nucleic acid sequence

SEQ ID NO: 1146 - protein, 109 aa, Artificial Sequence; identical to SEQ ID NO: 346
  Description of Artificial Sequence: Synthetic Light chain variable region amino acid sequence

SEQ ID NO: 1147 - protein, 14 aa, Artificial Sequence
  Description of Artificial Sequence: Synthetic Light chain variable region CDR L1 amino acid sequence
GSSTGAVTTSNYAN

SEQ ID NO: 1148 - DNA, 42 bp, Artificial Sequence; identical to SEQ ID NO: 204
  Description of Artificial Sequence: Synthetic Light chain variable region CDR L1 nucleic acid sequence

SEQ ID NO: 1149 - protein, 7 aa, Artificial Sequence
  Description of Artificial Sequence: Synthetic Light chain variable region CDR L2 amino acid sequence
GTDKRAP

SEQ ID NO: 1150 - DNA, 21 bp, Artificial Sequence
  Description of Artificial Sequence: Synthetic Light chain variable region CDR L2 nucleic acid sequence
ggcacagacaagcgcgctcct

SEQ ID NO: 1151 - protein, 9 aa, Artificial Sequence
  Description of Artificial Sequence: Synthetic Light chain variable region CDR L3 amino acid sequence
ALWYSNHWV

SEQ ID NO: 1152 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1153 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacgattacgctacatactacgcagactccgtgaaggatcggttcaccatctccagagacgattccaagagcacgctgtatctgcaaatggaaagcctgagagccgaggacacggcggtgtactactgcgtcaggcacggtaacttcggggaaggttacgtatcctggtttgctcattggggccaaggaaccctggtcaccgtctcctca

SEQ ID NO: 1154 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNDYATYYADSVKDRFTISRDDSKSTLYLQMESLRAEDTAVYYCVRHGNFGEGYVSWFAHWGQGTLVTVSS

SEQ ID NO: 1155 - protein, 9 aa, Artificial Sequence
  Description of Artificial Sequence: Synthetic Heavy chain variable region CDR H1 amino acid sequence
FTFDTYAMN

SEQ ID NO: 1156 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1157 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1158 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1159 - protein, 16 aa, Artificial Sequence
  Description of Artificial Sequence: Synthetic Heavy chain variable region CDR H3 amino acid sequence
VRHGNFGEGYVSWFAH

SEQ ID NO: 1160 - DNA, 48 bp, Artificial Sequence; identical to SEQ ID NO: 472
  Description of Artificial Sequence: Synthetic Heavy chain variable region CDR H3 nucleic acid sequence

SEQ ID NO: 1161 - DNA, 327 bp, Artificial Sequence; identical to SEQ ID NO: 345
  Description of Artificial Sequence: Synthetic Light chain variable region nucleic acid sequence

SEQ ID NO: 1162 - protein, 109 aa, Artificial Sequence; identical to SEQ ID NO: 346
  Description of Artificial Sequence: Synthetic Light chain variable region amino acid sequence

SEQ ID NO: 1163 - protein, 14 aa, Artificial Sequence
  Description of Artificial Sequence: Synthetic Light chain variable region CDR L1 amino acid sequence
GSSTGAVTTSNYAN

SEQ ID NO: 1164 - DNA, 42 bp, Artificial Sequence; identical to SEQ ID NO: 204
  Description of Artificial Sequence: Synthetic Light chain variable region CDR L1 nucleic acid sequence

SEQ ID NO: 1165 - protein, 7 aa, Artificial Sequence
  Description of Artificial Sequence: Synthetic Light chain variable region CDR L2 amino acid sequence
GTDKRAP

SEQ ID NO: 1166 - DNA, 21 bp, Artificial Sequence
  Description of Artificial Sequence: Synthetic Light chain variable region CDR L2 nucleic acid sequence
ggcacagacaagcgcgctcct

SEQ ID NO: 1167 - protein, 9 aa, Artificial Sequence
  Description of Artificial Sequence: Synthetic Light chain variable region CDR L3 amino acid sequence
ALWYSNHWV

SEQ ID NO: 1168 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1169 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacgattacgctacatactacgcagactccgtgaaggatcggttcaccatctccagagacgattccaagagcacgctgtatctgcaaatggaaagcctgagagccgaggacacggcggtgtactactgcgtcaggcacgataacttcggggctggttacgtatcctggtttgctcattggggccaaggaaccctggtcaccgtctcctca

SEQ ID NO: 1170 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNDYATYYADSVKDRFTISRDDSKSTLYLQMESLRAEDTAVYYCVRHDNFGAGYVSWFAHWGQGTLVTVSS

SEQ ID NO: 1171 - protein, 9 aa, Artificial Sequence
  Description of Artificial Sequence: Synthetic Heavy chain variable region CDR H1 amino acid sequence
FTFDTYAMN

SEQ ID NO: 1172 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1173 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1174 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1175 - protein, 16 aa, Artificial Sequence
  Description of Artificial Sequence: Synthetic Heavy chain variable region CDR H3 amino acid sequence
VRHDNFGAGYVSWFAH

SEQ ID NO: 1176 - DNA, 48 bp, Artificial Sequence; identical to SEQ ID NO: 1128
  Description of Artificial Sequence: Synthetic Heavy chain variable region CDR H3 nucleic acid sequence

SEQ ID NO: 1177 - DNA, 327 bp, Artificial Sequence; identical to SEQ ID NO: 345
  Description of Artificial Sequence: Synthetic Light chain variable region nucleic acid sequence

SEQ ID NO: 1178 - protein, 109 aa, Artificial Sequence; identical to SEQ ID NO: 346
  Description of Artificial Sequence: Synthetic Light chain variable region amino acid sequence

SEQ ID NO: 1179 - protein, 14 aa, Artificial Sequence
  Description of Artificial Sequence: Synthetic Light chain variable region CDR L1 amino acid sequence
GSSTGAVTTSNYAN

SEQ ID NO: 1180 - DNA, 42 bp, Artificial Sequence; identical to SEQ ID NO: 204
  Description of Artificial Sequence: Synthetic Light chain variable region CDR L1 nucleic acid sequence

SEQ ID NO: 1181 - protein, 7 aa, Artificial Sequence
  Description of Artificial Sequence: Synthetic Light chain variable region CDR L2 amino acid sequence
GTDKRAP

SEQ ID NO: 1182 - DNA, 21 bp, Artificial Sequence
  Description of Artificial Sequence: Synthetic Light chain variable region CDR L2 nucleic acid sequence
ggcacagacaagcgcgctcct

SEQ ID NO: 1183 - protein, 9 aa, Artificial Sequence
  Description of Artificial Sequence: Synthetic Light chain variable region CDR L3 amino acid sequence
ALWYSNHWV

SEQ ID NO: 1184 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1185 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacgattacgctacatactacgcagactccgtgaaggatcggttcaccatctccagagacgattccaagagcacgctgtatctgcaaatggaaagcctgagagccgaggacacggcggtgtactactgcgtcaggcacggtaacttcggggttggttacgtatcctggtttgcttcttggggccaaggaaccctggtcaccgtctcctca

SEQ ID NO: 1186 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNDYATYYADSVKDRFTISRDDSKSTLYLQMESLRAEDTAVYYCVRHGNFGVGYVSWFASWGQGTLVTVSS

SEQ ID NO: 1187 - protein, 9 aa, Artificial Sequence
  Description of Artificial Sequence: Synthetic Heavy chain variable region CDR H1 amino acid sequence
FTFDTYAMN

SEQ ID NO: 1188 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1189 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1190 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1191 - protein, 16 aa, Artificial Sequence
  Description of Artificial Sequence: Synthetic Heavy chain variable region CDR H3 amino acid sequence
VRHGNFGVGYVSWFAS

SEQ ID NO: 1192 - DNA, 48 bp, Artificial Sequence; identical to SEQ ID NO: 1144
  Description of Artificial Sequence: Synthetic Heavy chain variable region CDR H3 nucleic acid sequence

SEQ ID NO: 1193 - DNA, 327 bp, Artificial Sequence; identical to SEQ ID NO: 345
  Description of Artificial Sequence: Synthetic Light chain variable region nucleic acid sequence

SEQ ID NO: 1194 - protein, 109 aa, Artificial Sequence; identical to SEQ ID NO: 346
  Description of Artificial Sequence: Synthetic Light chain variable region amino acid sequence

SEQ ID NO: 1195 - protein, 14 aa, Artificial Sequence
  Description of Artificial Sequence: Synthetic Light chain variable region CDR L1 amino acid sequence
GSSTGAVTTSNYAN

SEQ ID NO: 1196 - DNA, 42 bp, Artificial Sequence; identical to SEQ ID NO: 204
  Description of Artificial Sequence: Synthetic Light chain variable region CDR L1 nucleic acid sequence

SEQ ID NO: 1197 - protein, 7 aa, Artificial Sequence
  Description of Artificial Sequence: Synthetic Light chain variable region CDR L2 amino acid sequence
GTDKRAP

SEQ ID NO: 1198 - DNA, 21 bp, Artificial Sequence
  Description of Artificial Sequence: Synthetic Light chain variable region CDR L2 nucleic acid sequence
ggcacagacaagcgcgctcct

SEQ ID NO: 1199 - protein, 9 aa, Artificial Sequence
  Description of Artificial Sequence: Synthetic Light chain variable region CDR L3 amino acid sequence
ALWYSNHWV

SEQ ID NO: 1200 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1201 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacgattacgctacatactacgcagactccgtgaaggatcggttcaccatctccagagacgattccaagagcacgctgtatctgcaaatggaaagcctgagagccgaggacacggcggtgtactactgcgtcaggcacggtaacttcgggggtgcttacgtatcctggtttgctcattggggccaaggaaccctggtcaccgtctcctca

SEQ ID NO: 1202 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNDYATYYADSVKDRFTISRDDSKSTLYLQMESLRAEDTAVYYCVRHGNFGGAYVSWFAHWGQGTLVTVSS

SEQ ID NO: 1203 - protein, 9 aa, Artificial Sequence
  Description of Artificial Sequence: Synthetic Heavy chain variable region CDR H1 amino acid sequence
FTFDTYAMN

SEQ ID NO: 1204 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1205 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1206 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1207 - protein, 16 aa, Artificial Sequence
  Description of Artificial Sequence: Synthetic Heavy chain variable region CDR H3 amino acid sequence
VRHGNFGGAYVSWFAH

SEQ ID NO: 1208 - DNA, 48 bp, Artificial Sequence
  Description of Artificial Sequence: Synthetic Heavy chain variable region CDR H3 nucleic acid sequence
gtcaggcacggtaacttcgggggtgcttacgtatcctggtttgctcat

SEQ ID NO: 1209 - DNA, 327 bp, Artificial Sequence; identical to SEQ ID NO: 345
  Description of Artificial Sequence: Synthetic Light chain variable region nucleic acid sequence

SEQ ID NO: 1210 - protein, 109 aa, Artificial Sequence; identical to SEQ ID NO: 346
  Description of Artificial Sequence: Synthetic Light chain variable region amino acid sequence

SEQ ID NO: 1211 - protein, 14 aa, Artificial Sequence
  Description of Artificial Sequence: Synthetic Light chain variable region CDR L1 amino acid sequence
GSSTGAVTTSNYAN

SEQ ID NO: 1212 - DNA, 42 bp, Artificial Sequence; identical to SEQ ID NO: 204
  Description of Artificial Sequence: Synthetic Light chain variable region CDR L1 nucleic acid sequence

SEQ ID NO: 1213 - protein, 7 aa, Artificial Sequence
  Description of Artificial Sequence: Synthetic Light chain variable region CDR L2 amino acid sequence
GTDKRAP

SEQ ID NO: 1214 - DNA, 21 bp, Artificial Sequence
  Description of Artificial Sequence: Synthetic Light chain variable region CDR L2 nucleic acid sequence
ggcacagacaagcgcgctcct

SEQ ID NO: 1215 - protein, 9 aa, Artificial Sequence
  Description of Artificial Sequence: Synthetic Light chain variable region CDR L3 amino acid sequence
ALWYSNHWV

SEQ ID NO: 1216 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1217 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacgcttatgccatgaactgggtgcgccaggctccagggaaggggctggagtgggtcgcaaggattagatccaagtataacgattacgctacatactacgcagactccgtgaaggatcggttcaccatctccagagacgattccaagagcacgctgtatctgcaaatggaaagcctgagagccgaggacacggcggtgtactactgcgtcaggcacggtaacttcggggggggttacgtatcctggtttgggcattggggccaaggaaccctggtcaccgtctcctca

SEQ ID NO: 1218 - protein, 125 aa, Artificial Sequence
  Description of Artificial Sequence: Synthetic Heavy chain variable region amino acid sequence
EVQLLESGGGLVQPGGSLRLSCAASGFTFDAYAMNWVRQAPGKGLEWVARIRSKYNDYATYYADSVKDRFTISRDDSKSTLYLQMESLRAEDTAVYYCVRHGNFGGGYVSWFGHWGQGTLVTVSS

SEQ ID NO: 1219 - protein, 9 aa, Artificial Sequence
  Description of Artificial Sequence: Synthetic Heavy chain variable region CDR H1 amino acid sequence
FTFDAYAMN

SEQ ID NO: 1220 - DNA, 27 bp, Artificial Sequence
  Description of Artificial Sequence: Synthetic Heavy chain variable region CDR H1 nucleic acid sequence
ttcacctttgacgcttatgccatgaac

SEQ ID NO: 1221 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1222 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1223 - protein, 16 aa, Artificial Sequence
  Description of Artificial Sequence: Synthetic Heavy chain variable region CDR H3 amino acid sequence
VRHGNFGGGYVSWFGH

SEQ ID NO: 1224 - DNA, 48 bp, Artificial Sequence
  Description of Artificial Sequence: Synthetic Heavy chain variable region CDR H3 nucleic acid sequence
gtcaggcacggtaacttcggggggggttacgtatcctggtttgggcat

SEQ ID NO: 1225 - DNA, 327 bp, Artificial Sequence; identical to SEQ ID NO: 345
  Description of Artificial Sequence: Synthetic Light chain variable region nucleic acid sequence

SEQ ID NO: 1226 - protein, 109 aa, Artificial Sequence; identical to SEQ ID NO: 346
  Description of Artificial Sequence: Synthetic Light chain variable region amino acid sequence

SEQ ID NO: 1227 - protein, 14 aa, Artificial Sequence
  Description of Artificial Sequence: Synthetic Light chain variable region CDR L1 amino acid sequence
GSSTGAVTTSNYAN

SEQ ID NO: 1228 - DNA, 42 bp, Artificial Sequence; identical to SEQ ID NO: 204
  Description of Artificial Sequence: Synthetic Light chain variable region CDR L1 nucleic acid sequence

SEQ ID NO: 1229 - protein, 7 aa, Artificial Sequence
  Description of Artificial Sequence: Synthetic Light chain variable region CDR L2 amino acid sequence
GTDKRAP

SEQ ID NO: 1230 - DNA, 21 bp, Artificial Sequence
  Description of Artificial Sequence: Synthetic Light chain variable region CDR L2 nucleic acid sequence
ggcacagacaagcgcgctcct

SEQ ID NO: 1231 - protein, 9 aa, Artificial Sequence
  Description of Artificial Sequence: Synthetic Light chain variable region CDR L3 amino acid sequence
ALWYSNHWV

SEQ ID NO: 1232 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1233 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacgcttatgccatgaactgggtgcgccaggctccagggaaggggctggagtgggtcgcaaggattagatccaagtataacgattacgctacatactacgcagactccgtgaaggatcggttcaccatctccagagacgattccaagagcacgctgtatctgcaaatggaaagcctgagagccgaggacacggcggtgtactactgcgtcaggcacggtaacttcgggaactatgctgtatcctggtttgctcattggggccaaggaaccctggtcaccgtctcctca

SEQ ID NO: 1234 - protein, 125 aa, Artificial Sequence
  Description of Artificial Sequence: Synthetic Heavy chain variable region amino acid sequence
EVQLLESGGGLVQPGGSLRLSCAASGFTFDAYAMNWVRQAPGKGLEWVARIRSKYNDYATYYADSVKDRFTISRDDSKSTLYLQMESLRAEDTAVYYCVRHGNFGNYAVSWFAHWGQGTLVTVSS

SEQ ID NO: 1235 - protein, 9 aa, Artificial Sequence
  Description of Artificial Sequence: Synthetic Heavy chain variable region CDR H1 amino acid sequence
FTFDAYAMN

SEQ ID NO: 1236 - DNA, 27 bp, Artificial Sequence
  Description of Artificial Sequence: Synthetic Heavy chain variable region CDR H1 nucleic acid sequence
ttcacctttgacgcttatgccatgaac

SEQ ID NO: 1237 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1238 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1239 - protein, 16 aa, Artificial Sequence
  Description of Artificial Sequence: Synthetic Heavy chain variable region CDR H3 amino acid sequence
VRHGNFGNYAVSWFAH

SEQ ID NO: 1240 - DNA, 48 bp, Artificial Sequence
  Description of Artificial Sequence: Synthetic Heavy chain variable region CDR H3 nucleic acid sequence
gtcaggcacggtaacttcgggaactatgctgtatcctggtttgctcat

SEQ ID NO: 1241 - DNA, 327 bp, Artificial Sequence; identical to SEQ ID NO: 345
  Description of Artificial Sequence: Synthetic Light chain variable region nucleic acid sequence

SEQ ID NO: 1242 - protein, 109 aa, Artificial Sequence; identical to SEQ ID NO: 346
  Description of Artificial Sequence: Synthetic Light chain variable region amino acid sequence

SEQ ID NO: 1243 - protein, 14 aa, Artificial Sequence
  Description of Artificial Sequence: Synthetic Light chain variable region CDR L1 amino acid sequence
GSSTGAVTTSNYAN

SEQ ID NO: 1244 - DNA, 42 bp, Artificial Sequence; identical to SEQ ID NO: 204
  Description of Artificial Sequence: Synthetic Light chain variable region CDR L1 nucleic acid sequence

SEQ ID NO: 1245 - protein, 7 aa, Artificial Sequence
  Description of Artificial Sequence: Synthetic Light chain variable region CDR L2 amino acid sequence
GTDKRAP

SEQ ID NO: 1246 - DNA, 21 bp, Artificial Sequence
  Description of Artificial Sequence: Synthetic Light chain variable region CDR L2 nucleic acid sequence
ggcacagacaagcgcgctcct

SEQ ID NO: 1247 - protein, 9 aa, Artificial Sequence
  Description of Artificial Sequence: Synthetic Light chain variable region CDR L3 amino acid sequence
ALWYSNHWV

SEQ ID NO: 1248 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1249 - DNA, 375 bp, Artificial Sequence; identical to SEQ ID NO: 1057
  Description of Artificial Sequence: Synthetic Heavy chain variable region nucleic acid sequence

SEQ ID NO: 1250 - protein, 125 aa, Artificial Sequence; identical to SEQ ID NO: 1058
  Description of Artificial Sequence: Synthetic Heavy chain variable region amino acid sequence

SEQ ID NO: 1251 - protein, 9 aa, Artificial Sequence
  Description of Artificial Sequence: Synthetic Heavy chain variable region CDR H1 amino acid sequence
FTFDTYAMN

SEQ ID NO: 1252 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1253 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1254 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1255 - protein, 16 aa, Artificial Sequence
  Description of Artificial Sequence: Synthetic Heavy chain variable region CDR H3 amino acid sequence
VRHGNFQGGYVSWFAH

SEQ ID NO: 1256 - DNA, 48 bp, Artificial Sequence; identical to SEQ ID NO: 1064
  Description of Artificial Sequence: Synthetic Heavy chain variable region CDR H3 nucleic acid sequence

SEQ ID NO: 1257 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagaggatgaagctgattattactgtgcgctgtggtacagtaacctttgggtgttcggcggagggaccaagctgaccgtccta

SEQ ID NO: 1258 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQAEDEADYYCALWYSNLWVFGGGTKLTVL

SEQ ID NO: 1259 - protein, 14 aa, Artificial Sequence
  Description of Artificial Sequence: Synthetic Light chain variable region CDR L1 amino acid sequence
GSSTGAVTTSNYAN

SEQ ID NO: 1260 - DNA, 42 bp, Artificial Sequence; identical to SEQ ID NO: 204
  Description of Artificial Sequence: Synthetic Light chain variable region CDR L1 nucleic acid sequence

SEQ ID NO: 1261 - protein, 7 aa, Artificial Sequence
  Description of Artificial Sequence: Synthetic Light chain variable region CDR L2 amino acid sequence
GTDKRAP

SEQ ID NO: 1262 - DNA, 21 bp, Artificial Sequence
  Description of Artificial Sequence: Synthetic Light chain variable region CDR L2 nucleic acid sequence
ggcacagacaagcgcgctcct

SEQ ID NO: 1263 - protein, 9 aa, Artificial Sequence
  Description of Artificial Sequence: Synthetic Light chain variable region CDR L3 amino acid sequence
ALWYSNLWV

SEQ ID NO: 1264 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1265 - DNA, 375 bp, Artificial Sequence; identical to SEQ ID NO: 1089
  Description of Artificial Sequence: Synthetic Heavy chain variable region nucleic acid sequence

SEQ ID NO: 1266 - protein, 125 aa, Artificial Sequence; identical to SEQ ID NO: 1090
  Description of Artificial Sequence: Synthetic Heavy chain variable region amino acid sequence

SEQ ID NO: 1267 - protein, 9 aa, Artificial Sequence
  Description of Artificial Sequence: Synthetic Heavy chain variable region CDR H1 amino acid sequence
FTFDTYAMN

SEQ ID NO: 1268 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1269 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1270 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1271 - protein, 16 aa, Artificial Sequence
  Description of Artificial Sequence: Synthetic Heavy chain variable region CDR H3 amino acid sequence
VRHANFGAGYVSWFAH

SEQ ID NO: 1272 - DNA, 48 bp, Artificial Sequence; identical to SEQ ID NO: 1096
  Description of Artificial Sequence: Synthetic Heavy chain variable region CDR H3 nucleic acid sequence

SEQ ID NO: 1273 - DNA, 327 bp, Artificial Sequence; identical to SEQ ID NO: 1257
  Description of Artificial Sequence: Synthetic Light chain variable region nucleic acid sequence

SEQ ID NO: 1274 - protein, 109 aa, Artificial Sequence; identical to SEQ ID NO: 1258
  Description of Artificial Sequence: Synthetic Light chain variable region amino acid sequence

SEQ ID NO: 1275 - protein, 14 aa, Artificial Sequence
  Description of Artificial Sequence: Synthetic Light chain variable region CDR L1 amino acid sequence
GSSTGAVTTSNYAN

SEQ ID NO: 1276 - DNA, 42 bp, Artificial Sequence; identical to SEQ ID NO: 204
  Description of Artificial Sequence: Synthetic Light chain variable region CDR L1 nucleic acid sequence

SEQ ID NO: 1277 - protein, 7 aa, Artificial Sequence
  Description of Artificial Sequence: Synthetic Light chain variable region CDR L2 amino acid sequence
GTDKRAP

SEQ ID NO: 1278 - DNA, 21 bp, Artificial Sequence
  Description of Artificial Sequence: Synthetic Light chain variable region CDR L2 nucleic acid sequence
ggcacagacaagcgcgctcct

SEQ ID NO: 1279 - protein, 9 aa, Artificial Sequence
  Description of Artificial Sequence: Synthetic Light chain variable region CDR L3 amino acid sequence
ALWYSNLWV

SEQ ID NO: 1280 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1281 - DNA, 375 bp, Artificial Sequence; identical to SEQ ID NO: 1105
  Description of Artificial Sequence: Synthetic Heavy chain variable region nucleic acid sequence

SEQ ID NO: 1282 - protein, 125 aa, Artificial Sequence; identical to SEQ ID NO: 482
  Description of Artificial Sequence: Synthetic Heavy chain variable region amino acid sequence

SEQ ID NO: 1283 - protein, 9 aa, Artificial Sequence
  Description of Artificial Sequence: Synthetic Heavy chain variable region CDR H1 amino acid sequence
FTFDTYAMN

SEQ ID NO: 1284 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1285 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1286 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1287 - protein, 16 aa, Artificial Sequence
  Description of Artificial Sequence: Synthetic Heavy chain variable region CDR H3 amino acid sequence
VRHGNFGEGYVSWFAH

SEQ ID NO: 1288 - DNA, 48 bp, Artificial Sequence; identical to SEQ ID NO: 472
  Description of Artificial Sequence: Synthetic Heavy chain variable region CDR H3 nucleic acid sequence

SEQ ID NO: 1289 - DNA, 327 bp, Artificial Sequence; identical to SEQ ID NO: 1257
  Description of Artificial Sequence: Synthetic Light chain variable region nucleic acid sequence

SEQ ID NO: 1290 - protein, 109 aa, Artificial Sequence; identical to SEQ ID NO: 1258
  Description of Artificial Sequence: Synthetic Light chain variable region amino acid sequence

SEQ ID NO: 1291 - protein, 14 aa, Artificial Sequence
  Description of Artificial Sequence: Synthetic Light chain variable region CDR L1 amino acid sequence
GSSTGAVTTSNYAN

SEQ ID NO: 1292 - DNA, 42 bp, Artificial Sequence; identical to SEQ ID NO: 204
  Description of Artificial Sequence: Synthetic Light chain variable region CDR L1 nucleic acid sequence

SEQ ID NO: 1293 - protein, 7 aa, Artificial Sequence
  Description of Artificial Sequence: Synthetic Light chain variable region CDR L2 amino acid sequence
GTDKRAP

SEQ ID NO: 1294 - DNA, 21 bp, Artificial Sequence
  Description of Artificial Sequence: Synthetic Light chain variable region CDR L2 nucleic acid sequence
ggcacagacaagcgcgctcct

SEQ ID NO: 1295 - protein, 9 aa, Artificial Sequence
  Description of Artificial Sequence: Synthetic Light chain variable region CDR L3 amino acid sequence
ALWYSNLWV

SEQ ID NO: 1296 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1297 - DNA, 375 bp, Artificial Sequence; identical to SEQ ID NO: 1121
  Description of Artificial Sequence: Synthetic Heavy chain variable region nucleic acid sequence

SEQ ID NO: 1298 - protein, 125 aa, Artificial Sequence; identical to SEQ ID NO: 1122
  Description of Artificial Sequence: Synthetic Heavy chain variable region amino acid sequence

SEQ ID NO: 1299 - protein, 9 aa, Artificial Sequence
  Description of Artificial Sequence: Synthetic Heavy chain variable region CDR H1 amino acid sequence
FTFDTYAMN

SEQ ID NO: 1300 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1301 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1302 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1303 - protein, 16 aa, Artificial Sequence
  Description of Artificial Sequence: Synthetic Heavy chain variable region CDR H3 amino acid sequence
VRHDNFGAGYVSWFAH

SEQ ID NO: 1304 - DNA, 48 bp, Artificial Sequence; identical to SEQ ID NO: 1128
  Description of Artificial Sequence: Synthetic Heavy chain variable region CDR H3 nucleic acid sequence

SEQ ID NO: 1305 - DNA, 327 bp, Artificial Sequence; identical to SEQ ID NO: 1257
  Description of Artificial Sequence: Synthetic Light chain variable region nucleic acid sequence

SEQ ID NO: 1306 - protein, 109 aa, Artificial Sequence; identical to SEQ ID NO: 1258
  Description of Artificial Sequence: Synthetic Light chain variable region amino acid sequence

SEQ ID NO: 1307 - protein, 14 aa, Artificial Sequence
  Description of Artificial Sequence: Synthetic Light chain variable region CDR L1 amino acid sequence
GSSTGAVTTSNYAN

SEQ ID NO: 1308 - DNA, 42 bp, Artificial Sequence; identical to SEQ ID NO: 204
  Description of Artificial Sequence: Synthetic Light chain variable region CDR L1 nucleic acid sequence

SEQ ID NO: 1309 - protein, 7 aa, Artificial Sequence
  Description of Artificial Sequence: Synthetic Light chain variable region CDR L2 amino acid sequence
GTDKRAP

SEQ ID NO: 1310 - DNA, 21 bp, Artificial Sequence
  Description of Artificial Sequence: Synthetic Light chain variable region CDR L2 nucleic acid sequence
ggcacagacaagcgcgctcct

SEQ ID NO: 1311 - protein, 9 aa, Artificial Sequence
  Description of Artificial Sequence: Synthetic Light chain variable region CDR L3 amino acid sequence
ALWYSNLWV

SEQ ID NO: 1312 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1313 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttcgggggtgcttacgtatcctggtttgctcattggggccaaggaaccctggtcaccgtctcctca

SEQ ID NO: 1314 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHGNFGGAYVSWFAHWGQGTLVTVSS

SEQ ID NO: 1315 - protein, 9 aa, Artificial Sequence
  Description of Artificial Sequence: Synthetic Heavy chain variable region CDR H1 amino acid sequence
FTFDTYAMN

SEQ ID NO: 1316 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1317 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1318 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1319 - protein, 16 aa, Artificial Sequence
  Description of Artificial Sequence: Synthetic Heavy chain variable region CDR H3 amino acid sequence
VRHGNFGGAYVSWFAH

SEQ ID NO: 1320 - DNA, 48 bp, Artificial Sequence; identical to SEQ ID NO: 1208
  Description of Artificial Sequence: Synthetic Heavy chain variable region CDR H3 nucleic acid sequence

SEQ ID NO: 1321 - DNA, 327 bp, Artificial Sequence; identical to SEQ ID NO: 1257
  Description of Artificial Sequence: Synthetic Light chain variable region nucleic acid sequence

SEQ ID NO: 1322 - protein, 109 aa, Artificial Sequence; identical to SEQ ID NO: 1258
  Description of Artificial Sequence: Synthetic Light chain variable region amino acid sequence

SEQ ID NO: 1323 - protein, 14 aa, Artificial Sequence
  Description of Artificial Sequence: Synthetic Light chain variable region CDR L1 amino acid sequence
GSSTGAVTTSNYAN

SEQ ID NO: 1324 - DNA, 42 bp, Artificial Sequence; identical to SEQ ID NO: 204
  Description of Artificial Sequence: Synthetic Light chain variable region CDR L1 nucleic acid sequence

SEQ ID NO: 1325 - protein, 7 aa, Artificial Sequence
  Description of Artificial Sequence: Synthetic Light chain variable region CDR L2 amino acid sequence
GTDKRAP

SEQ ID NO: 1326 - DNA, 21 bp, Artificial Sequence
  Description of Artificial Sequence: Synthetic Light chain variable region CDR L2 nucleic acid sequence
ggcacagacaagcgcgctcct

SEQ ID NO: 1327 - protein, 9 aa, Artificial Sequence
  Description of Artificial Sequence: Synthetic Light chain variable region CDR L3 amino acid sequence
ALWYSNLWV

SEQ ID NO: 1328 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1329 - DNA, 375 bp, Artificial Sequence; identical to SEQ ID NO: 1153
  Description of Artificial Sequence: Synthetic Heavy chain variable region nucleic acid sequence

SEQ ID NO: 1330 - protein, 125 aa, Artificial Sequence; identical to SEQ ID NO: 1154
  Description of Artificial Sequence: Synthetic Heavy chain variable region amino acid sequence

SEQ ID NO: 1331 - protein, 9 aa, Artificial Sequence
  Description of Artificial Sequence: Synthetic Heavy chain variable region CDR H1 amino acid sequence
FTFDTYAMN

SEQ ID NO: 1332 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1333 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1334 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1335 - protein, 16 aa, Artificial Sequence
  Description of Artificial Sequence: Synthetic Heavy chain variable region CDR H3 amino acid sequence
VRHGNFGEGYVSWFAH

SEQ ID NO: 1336 - DNA, 48 bp, Artificial Sequence; identical to SEQ ID NO: 472
  Description of Artificial Sequence: Synthetic Heavy chain variable region CDR H3 nucleic acid sequence

SEQ ID NO: 1337 - DNA, 327 bp, Artificial Sequence; identical to SEQ ID NO: 1257
  Description of Artificial Sequence: Synthetic Light chain variable region nucleic acid sequence

SEQ ID NO: 1338 - protein, 109 aa, Artificial Sequence; identical to SEQ ID NO: 1258
  Description of Artificial Sequence: Synthetic Light chain variable region amino acid sequence

SEQ ID NO: 1339 - protein, 14 aa, Artificial Sequence
  Description of Artificial Sequence: Synthetic Light chain variable region CDR L1 amino acid sequence
GSSTGAVTTSNYAN

SEQ ID NO: 1340 - DNA, 42 bp, Artificial Sequence; identical to SEQ ID NO: 204
  Description of Artificial Sequence: Synthetic Light chain variable region CDR L1 nucleic acid sequence

SEQ ID NO: 1341 - protein, 7 aa, Artificial Sequence
  Description of Artificial Sequence: Synthetic Light chain variable region CDR L2 amino acid sequence
GTDKRAP

SEQ ID NO: 1342 - DNA, 21 bp, Artificial Sequence
  Description of Artificial Sequence: Synthetic Light chain variable region CDR L2 nucleic acid sequence
ggcacagacaagcgcgctcct

SEQ ID NO: 1343 - protein, 9 aa, Artificial Sequence
  Description of Artificial Sequence: Synthetic Light chain variable region CDR L3 amino acid sequence
ALWYSNLWV

SEQ ID NO: 1344 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1345 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaactgggtgcgccaggctccagggaaggggctggagtgggtcgcaaggattagatccaagtataacgattacgctacatactacgcagactccgtgaaggatcggttcaccatctccagagacgattccaagagcacgctgtatctgcaaatggaaagcctgagagccgaggacacggcggtgtactactgcgtcaggcacgataacttcggggctggttacgtatcatggtttgctcattggggccaaggaaccctggtcaccgtatcctca

SEQ ID NO: 1346 - protein, 125 aa, Artificial Sequence; identical to SEQ ID NO: 1170
  Description of Artificial Sequence: Synthetic Heavy chain variable region amino acid sequence

SEQ ID NO: 1347 - protein, 9 aa, Artificial Sequence
  Description of Artificial Sequence: Synthetic Heavy chain variable region CDR H1 amino acid sequence
FTFDTYAMN

SEQ ID NO: 1348 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1349 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1350 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1351 - protein, 16 aa, Artificial Sequence
  Description of Artificial Sequence: Synthetic Heavy chain variable region CDR H3 amino acid sequence
VRHDNFGAGYVSWFAH

SEQ ID NO: 1352 - DNA, 48 bp, Artificial Sequence
  Description of Artificial Sequence: Synthetic Heavy chain variable region CDR H3 nucleic acid sequence
gtcaggcacgataacttcggggctggttacgtatcatggtttgctcat

SEQ ID NO: 1353 - DNA, 327 bp, Artificial Sequence; identical to SEQ ID NO: 1257
  Description of Artificial Sequence: Synthetic Light chain variable region nucleic acid sequence

SEQ ID NO: 1354 - protein, 109 aa, Artificial Sequence; identical to SEQ ID NO: 1258
  Description of Artificial Sequence: Synthetic Light chain variable region amino acid sequence

SEQ ID NO: 1355 - protein, 14 aa, Artificial Sequence
  Description of Artificial Sequence: Synthetic Light chain variable region CDR L1 amino acid sequence
GSSTGAVTTSNYAN

SEQ ID NO: 1356 - DNA, 42 bp, Artificial Sequence; identical to SEQ ID NO: 204
  Description of Artificial Sequence: Synthetic Light chain variable region CDR L1 nucleic acid sequence

SEQ ID NO: 1357 - protein, 7 aa, Artificial Sequence
  Description of Artificial Sequence: Synthetic Light chain variable region CDR L2 amino acid sequence
GTDKRAP

SEQ ID NO: 1358 - DNA, 21 bp, Artificial Sequence
  Description of Artificial Sequence: Synthetic Light chain variable region CDR L2 nucleic acid sequence
ggcacagacaagcgcgctcct

SEQ ID NO: 1359 - protein, 9 aa, Artificial Sequence
  Description of Artificial Sequence: Synthetic Light chain variable region CDR L3 amino acid sequence
ALWYSNLWV

SEQ ID NO: 1360 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1361 - DNA, 375 bp, Artificial Sequence; identical to SEQ ID NO: 1185
  Description of Artificial Sequence: Synthetic Heavy chain variable region nucleic acid sequence

SEQ ID NO: 1362 - protein, 125 aa, Artificial Sequence; identical to SEQ ID NO: 1186
  Description of Artificial Sequence: Synthetic Heavy chain variable region amino acid sequence

SEQ ID NO: 1363 - protein, 9 aa, Artificial Sequence
  Description of Artificial Sequence: Synthetic Heavy chain variable region CDR H1 amino acid sequence
FTFDTYAMN

SEQ ID NO: 1364 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1365 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1366 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1367 - protein, 16 aa, Artificial Sequence
  Description of Artificial Sequence: Synthetic Heavy chain variable region CDR H3 amino acid sequence
VRHGNFGVGYVSWFAS

SEQ ID NO: 1368 - DNA, 48 bp, Artificial Sequence; identical to SEQ ID NO: 1144
  Description of Artificial Sequence: Synthetic Heavy chain variable region CDR H3 nucleic acid sequence

SEQ ID NO: 1369 - DNA, 327 bp, Artificial Sequence; identical to SEQ ID NO: 1257
  Description of Artificial Sequence: Synthetic Light chain variable region nucleic acid sequence

SEQ ID NO: 1370 - protein, 109 aa, Artificial Sequence; identical to SEQ ID NO: 1258
  Description of Artificial Sequence: Synthetic Light chain variable region amino acid sequence

SEQ ID NO: 1371 - protein, 14 aa, Artificial Sequence
  Description of Artificial Sequence: Synthetic Light chain variable region CDR L1 amino acid sequence
GSSTGAVTTSNYAN

SEQ ID NO: 1372 - DNA, 42 bp, Artificial Sequence; identical to SEQ ID NO: 204
  Description of Artificial Sequence: Synthetic Light chain variable region CDR L1 nucleic acid sequence

SEQ ID NO: 1373 - protein, 7 aa, Artificial Sequence
  Description of Artificial Sequence: Synthetic Light chain variable region CDR L2 amino acid sequence
GTDKRAP

SEQ ID NO: 1374 - DNA, 21 bp, Artificial Sequence
  Description of Artificial Sequence: Synthetic Light chain variable region CDR L2 nucleic acid sequence
ggcacagacaagcgcgctcct

SEQ ID NO: 1375 - protein, 9 aa, Artificial Sequence
  Description of Artificial Sequence: Synthetic Light chain variable region CDR L3 amino acid sequence
ALWYSNLWV

SEQ ID NO: 1376 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1377 - DNA, 375 bp, Artificial Sequence; identical to SEQ ID NO: 1201
  Description of Artificial Sequence: Synthetic Heavy chain variable region nucleic acid sequence

SEQ ID NO: 1378 - protein, 125 aa, Artificial Sequence; identical to SEQ ID NO: 1202
  Description of Artificial Sequence: Synthetic Heavy chain variable region amino acid sequence

SEQ ID NO: 1379 - protein, 9 aa, Artificial Sequence
  Description of Artificial Sequence: Synthetic Heavy chain variable region CDR H1 amino acid sequence
FTFDTYAMN

SEQ ID NO: 1380 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1381 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1382 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1383 - protein, 16 aa, Artificial Sequence
  Description of Artificial Sequence: Synthetic Heavy chain variable region CDR H3 amino acid sequence
VRHGNFGGAYVSWFAH

SEQ ID NO: 1384 - DNA, 48 bp, Artificial Sequence; identical to SEQ ID NO: 1208
  Description of Artificial Sequence: Synthetic Heavy chain variable region CDR H3 nucleic acid sequence

SEQ ID NO: 1385 - DNA, 327 bp, Artificial Sequence; identical to SEQ ID NO: 1257
  Description of Artificial Sequence: Synthetic Light chain variable region nucleic acid sequence

SEQ ID NO: 1386 - protein, 109 aa, Artificial Sequence; identical to SEQ ID NO: 1258
  Description of Artificial Sequence: Synthetic Light chain variable region amino acid sequence

SEQ ID NO: 1387 - protein, 14 aa, Artificial Sequence
  Description of Artificial Sequence: Synthetic Light chain variable region CDR L1 amino acid sequence
GSSTGAVTTSNYAN

SEQ ID NO: 1388 - DNA, 42 bp, Artificial Sequence; identical to SEQ ID NO: 204
  Description of Artificial Sequence: Synthetic Light chain variable region CDR L1 nucleic acid sequence

SEQ ID NO: 1389 - protein, 7 aa, Artificial Sequence
  Description of Artificial Sequence: Synthetic Light chain variable region CDR L2 amino acid sequence
GTDKRAP

SEQ ID NO: 1390 - DNA, 21 bp, Artificial Sequence
  Description of Artificial Sequence: Synthetic Light chain variable region CDR L2 nucleic acid sequence
ggcacagacaagcgcgctcct

SEQ ID NO: 1391 - protein, 9 aa, Artificial Sequence
  Description of Artificial Sequence: Synthetic Light chain variable region CDR L3 amino acid sequence
ALWYSNLWV

SEQ ID NO: 1392 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1393 - DNA, 375 bp, Artificial Sequence; identical to SEQ ID NO: 1217
  Description of Artificial Sequence: Synthetic Heavy chain variable region nucleic acid sequence

SEQ ID NO: 1394 - protein, 125 aa, Artificial Sequence; identical to SEQ ID NO: 1218
  Description of Artificial Sequence: Synthetic Heavy chain variable region amino acid sequence

SEQ ID NO: 1395 - protein, 9 aa, Artificial Sequence
  Description of Artificial Sequence: Synthetic Heavy chain variable region CDR H1 amino acid sequence
FTFDAYAMN

SEQ ID NO: 1396 - DNA, 27 bp, Artificial Sequence
  Description of Artificial Sequence: Synthetic Heavy chain variable region CDR H1 nucleic acid sequence
ttcacctttgacgcttatgccatgaac

SEQ ID NO: 1397 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1398 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1399 - protein, 16 aa, Artificial Sequence
  Description of Artificial Sequence: Synthetic Heavy chain variable region CDR H3 amino acid sequence
VRHGNFGGGYVSWFGH

SEQ ID NO: 1400 - DNA, 48 bp, Artificial Sequence; identical to SEQ ID NO: 1224
  Description of Artificial Sequence: Synthetic Heavy chain variable region CDR H3 nucleic acid sequence

SEQ ID NO: 1401 - DNA, 327 bp, Artificial Sequence; identical to SEQ ID NO: 1257
  Description of Artificial Sequence: Synthetic Light chain variable region nucleic acid sequence

SEQ ID NO: 1402 - protein, 109 aa, Artificial Sequence; identical to SEQ ID NO: 1258
  Description of Artificial Sequence: Synthetic Light chain variable region amino acid sequence

SEQ ID NO: 1403 - protein, 14 aa, Artificial Sequence
  Description of Artificial Sequence: Synthetic Light chain variable region CDR L1 amino acid sequence
GSSTGAVTTSNYAN

SEQ ID NO: 1404 - DNA, 42 bp, Artificial Sequence; identical to SEQ ID NO: 204
  Description of Artificial Sequence: Synthetic Light chain variable region CDR L1 nucleic acid sequence

SEQ ID NO: 1405 - protein, 7 aa, Artificial Sequence
  Description of Artificial Sequence: Synthetic Light chain variable region CDR L2 amino acid sequence
GTDKRAP

SEQ ID NO: 1406 - DNA, 21 bp, Artificial Sequence
  Description of Artificial Sequence: Synthetic Light chain variable region CDR L2 nucleic acid sequence
ggcacagacaagcgcgctcct

SEQ ID NO: 1407 - protein, 9 aa, Artificial Sequence
  Description of Artificial Sequence: Synthetic Light chain variable region CDR L3 amino acid sequence
ALWYSNLWV

SEQ ID NO: 1408 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1409 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacgcttatgccatgaactgggtgcgccaggctccagggaaggggctggagtgggtcgcaaggattagatccaagtataacgattacgctacatactacgcagactccgtgaaggatcggttcaccatctccagagacgattccaagagcacgctgtatctgcaaatggaaagcctgagagccgaggacacggcggtgtactactgcgtcaggcacggtaacgtggggggtggttacgtatcctggtttgctcattggggccaaggaaccctggtcaccgtctcctca

SEQ ID NO: 1410 - protein, 125 aa, Artificial Sequence
  Description of Artificial Sequence: Synthetic Heavy chain variable region amino acid sequence
EVQLLESGGGLVQPGGSLRLSCAASGFTFDAYAMNWVRQAPGKGLEWVARIRSKYNDYATYYADSVKDRFTISRDDSKSTLYLQMESLRAEDTAVYYCVRHGNVGGGYVSWFAHWGQGTLVTVSS

SEQ ID NO: 1411 - protein, 9 aa, Artificial Sequence
  Description of Artificial Sequence: Synthetic Heavy chain variable region CDR H1 amino acid sequence
FTFDAYAMN

SEQ ID NO: 1412 - DNA, 27 bp, Artificial Sequence
  Description of Artificial Sequence: Synthetic Heavy chain variable region CDR H1 nucleic acid sequence
ttcacctttgacgcttatgccatgaac

SEQ ID NO: 1413 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1414 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1415 - protein, 16 aa, Artificial Sequence
  Description of Artificial Sequence: Synthetic Heavy chain variable region CDR H3 amino acid sequence
VRHGNVGGGYVSWFAH

SEQ ID NO: 1416 - DNA, 48 bp, Artificial Sequence
  Description of Artificial Sequence: Synthetic Heavy chain variable region CDR H3 nucleic acid sequence
gtcaggcacggtaacgtggggggtggttacgtatcctggtttgctcat

SEQ ID NO: 1417 - DNA, 327 bp, Artificial Sequence; identical to SEQ ID NO: 1257
  Description of Artificial Sequence: Synthetic Light chain variable region nucleic acid sequence

SEQ ID NO: 1418 - protein, 109 aa, Artificial Sequence; identical to SEQ ID NO: 1258
  Description of Artificial Sequence: Synthetic Light chain variable region amino acid sequence

SEQ ID NO: 1419 - protein, 14 aa, Artificial Sequence
  Description of Artificial Sequence: Synthetic Light chain variable region CDR L1 amino acid sequence
GSSTGAVTTSNYAN

SEQ ID NO: 1420 - DNA, 42 bp, Artificial Sequence; identical to SEQ ID NO: 204
  Description of Artificial Sequence: Synthetic Light chain variable region CDR L1 nucleic acid sequence

SEQ ID NO: 1421 - protein, 7 aa, Artificial Sequence
  Description of Artificial Sequence: Synthetic Light chain variable region CDR L2 amino acid sequence
GTDKRAP

SEQ ID NO: 1422 - DNA, 21 bp, Artificial Sequence
  Description of Artificial Sequence: Synthetic Light chain variable region CDR L2 nucleic acid sequence
ggcacagacaagcgcgctcct

SEQ ID NO: 1423 - protein, 9 aa, Artificial Sequence
  Description of Artificial Sequence: Synthetic Light chain variable region CDR L3 amino acid sequence
ALWYSNLWV

SEQ ID NO: 1424 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1425 - DNA, 375 bp, Artificial Sequence; identical to SEQ ID NO: 1233
  Description of Artificial Sequence: Synthetic Heavy chain variable region nucleic acid sequence

SEQ ID NO: 1426 - protein, 125 aa, Artificial Sequence; identical to SEQ ID NO: 1234
  Description of Artificial Sequence: Synthetic Heavy chain variable region amino acid sequence

SEQ ID NO: 1427 - protein, 9 aa, Artificial Sequence
  Description of Artificial Sequence: Synthetic Heavy chain variable region CDR H1 amino acid sequence
FTFDAYAMN

SEQ ID NO: 1428 - DNA, 27 bp, Artificial Sequence
  Description of Artificial Sequence: Synthetic Heavy chain variable region CDR H1 nucleic acid sequence
ttcacctttgacgcttatgccatgaac

SEQ ID NO: 1429 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1430 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1431 - protein, 16 aa, Artificial Sequence
  Description of Artificial Sequence: Synthetic Heavy chain variable region CDR H3 amino acid sequence
VRHGNFGNYAVSWFAH

SEQ ID NO: 1432 - DNA, 48 bp, Artificial Sequence; identical to SEQ ID NO: 1240
  Description of Artificial Sequence: Synthetic Heavy chain variable region CDR H3 nucleic acid sequence

SEQ ID NO: 1433 - DNA, 327 bp, Artificial Sequence; identical to SEQ ID NO: 1257
  Description of Artificial Sequence: Synthetic Light chain variable region nucleic acid sequence

SEQ ID NO: 1434 - protein, 109 aa, Artificial Sequence; identical to SEQ ID NO: 1258
  Description of Artificial Sequence: Synthetic Light chain variable region amino acid sequence

SEQ ID NO: 1435 - protein, 14 aa, Artificial Sequence
  Description of Artificial Sequence: Synthetic Light chain variable region CDR L1 amino acid sequence
GSSTGAVTTSNYAN

SEQ ID NO: 1436 - DNA, 42 bp, Artificial Sequence; identical to SEQ ID NO: 204
  Description of Artificial Sequence: Synthetic Light chain variable region CDR L1 nucleic acid sequence

SEQ ID NO: 1437 - protein, 7 aa, Artificial Sequence
  Description of Artificial Sequence: Synthetic Light chain variable region CDR L2 amino acid sequence
GTDKRAP

SEQ ID NO: 1438 - DNA, 21 bp, Artificial Sequence
  Description of Artificial Sequence: Synthetic Light chain variable region CDR L2 nucleic acid sequence
ggcacagacaagcgcgctcct

SEQ ID NO: 1439 - protein, 9 aa, Artificial Sequence
  Description of Artificial Sequence: Synthetic Light chain variable region CDR L3 amino acid sequence
ALWYSNLWV

SEQ ID NO: 1440 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1441 - DNA, 375 bp, Artificial Sequence; identical to SEQ ID NO: 1057
  Description of Artificial Sequence: Synthetic Heavy chain variable region nucleic acid sequence

SEQ ID NO: 1442 - protein, 125 aa, Artificial Sequence; identical to SEQ ID NO: 1058
  Description of Artificial Sequence: Synthetic Heavy chain variable region amino acid sequence

SEQ ID NO: 1443 - protein, 9 aa, Artificial Sequence
  Description of Artificial Sequence: Synthetic Heavy chain variable region CDR H1 amino acid sequence
FTFDTYAMN

SEQ ID NO: 1444 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1445 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1446 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1447 - protein, 16 aa, Artificial Sequence
  Description of Artificial Sequence: Synthetic Heavy chain variable region CDR H3 amino acid sequence
VRHGNFQGGYVSWFAH

SEQ ID NO: 1448 - DNA, 48 bp, Artificial Sequence; identical to SEQ ID NO: 1064
  Description of Artificial Sequence: Synthetic Heavy chain variable region CDR H3 nucleic acid sequence

SEQ ID NO: 1449 - DNA, 327 bp, Artificial Sequence; identical to SEQ ID NO: 425
  Description of Artificial Sequence: Synthetic Light chain variable region nucleic acid sequence

SEQ ID NO: 1450 - protein, 109 aa, Artificial Sequence; identical to SEQ ID NO: 426
  Description of Artificial Sequence: Synthetic Light chain variable region amino acid sequence

SEQ ID NO: 1451 - protein, 14 aa, Artificial Sequence
  Description of Artificial Sequence: Synthetic Light chain variable region CDR L1 amino acid sequence
GSSTGAVTTSNYAN

SEQ ID NO: 1452 - DNA, 42 bp, Artificial Sequence; identical to SEQ ID NO: 204
  Description of Artificial Sequence: Synthetic Light chain variable region CDR L1 nucleic acid sequence

SEQ ID NO: 1453 - protein, 7 aa, Artificial Sequence
  Description of Artificial Sequence: Synthetic Light chain variable region CDR L2 amino acid sequence
GTDKRAP

SEQ ID NO: 1454 - DNA, 21 bp, Artificial Sequence
  Description of Artificial Sequence: Synthetic Light chain variable region CDR L2 nucleic acid sequence
ggcacagacaagcgcgctcct

SEQ ID NO: 1455 - protein, 9 aa, Artificial Sequence
  Description of Artificial Sequence: Synthetic Light chain variable region CDR L3 amino acid sequence
ALWYSDLWV

SEQ ID NO: 1456 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1457 - DNA, 375 bp, Artificial Sequence; identical to SEQ ID NO: 1073
  Description of Artificial Sequence: Synthetic Heavy chain variable region nucleic acid sequence

SEQ ID NO: 1458 - protein, 125 aa, Artificial Sequence; identical to SEQ ID NO: 1074
  Description of Artificial Sequence: Synthetic Heavy chain variable region amino acid sequence

SEQ ID NO: 1459 - protein, 9 aa, Artificial Sequence
  Description of Artificial Sequence: Synthetic Heavy chain variable region CDR H1 amino acid sequence
FTFDTYAMN

SEQ ID NO: 1460 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1461 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1462 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1463 - protein, 16 aa, Artificial Sequence
  Description of Artificial Sequence: Synthetic Heavy chain variable region CDR H3 amino acid sequence
VRHGNFGGGYVSWFAW

SEQ ID NO: 1464 - DNA, 48 bp, Artificial Sequence; identical to SEQ ID NO: 1080
  Description of Artificial Sequence: Synthetic Heavy chain variable region CDR H3 nucleic acid sequence

SEQ ID NO: 1465 - DNA, 327 bp, Artificial Sequence; identical to SEQ ID NO: 425
  Description of Artificial Sequence: Synthetic Light chain variable region nucleic acid sequence

SEQ ID NO: 1466 - protein, 109 aa, Artificial Sequence; identical to SEQ ID NO: 426
  Description of Artificial Sequence: Synthetic Light chain variable region amino acid sequence

SEQ ID NO: 1467 - protein, 14 aa, Artificial Sequence
  Description of Artificial Sequence: Synthetic Light chain variable region CDR L1 amino acid sequence
GSSTGAVTTSNYAN

SEQ ID NO: 1468 - DNA, 42 bp, Artificial Sequence; identical to SEQ ID NO: 204
  Description of Artificial Sequence: Synthetic Light chain variable region CDR L1 nucleic acid sequence

SEQ ID NO: 1469 - protein, 7 aa, Artificial Sequence
  Description of Artificial Sequence: Synthetic Light chain variable region CDR L2 amino acid sequence
GTDKRAP

SEQ ID NO: 1470 - DNA, 21 bp, Artificial Sequence
  Description of Artificial Sequence: Synthetic Light chain variable region CDR L2 nucleic acid sequence
ggcacagacaagcgcgctcct

SEQ ID NO: 1471 - protein, 9 aa, Artificial Sequence
  Description of Artificial Sequence: Synthetic Light chain variable region CDR L3 amino acid sequence
ALWYSDLWV

SEQ ID NO: 1472 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1473 - DNA, 375 bp, Artificial Sequence; identical to SEQ ID NO: 1089
  Description of Artificial Sequence: Synthetic Heavy chain variable region nucleic acid sequence

SEQ ID NO: 1474 - protein, 125 aa, Artificial Sequence; identical to SEQ ID NO: 1090
  Description of Artificial Sequence: Synthetic Heavy chain variable region amino acid sequence

SEQ ID NO: 1475 - protein, 9 aa, Artificial Sequence
  Description of Artificial Sequence: Synthetic Heavy chain variable region CDR H1 amino acid sequence
FTFDTYAMN

SEQ ID NO: 1476 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1477 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1478 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1479 - protein, 16 aa, Artificial Sequence
  Description of Artificial Sequence: Synthetic Heavy chain variable region CDR H3 amino acid sequence
VRHANFGAGYVSWFAH

SEQ ID NO: 1480 - DNA, 48 bp, Artificial Sequence; identical to SEQ ID NO: 1096
  Description of Artificial Sequence: Synthetic Heavy chain variable region CDR H3 nucleic acid sequence

SEQ ID NO: 1481 - DNA, 327 bp, Artificial Sequence; identical to SEQ ID NO: 425
  Description of Artificial Sequence: Synthetic Light chain variable region nucleic acid sequence

SEQ ID NO: 1482 - protein, 109 aa, Artificial Sequence; identical to SEQ ID NO: 426
  Description of Artificial Sequence: Synthetic Light chain variable region amino acid sequence

SEQ ID NO: 1483 - protein, 14 aa, Artificial Sequence
  Description of Artificial Sequence: Synthetic Light chain variable region CDR L1 amino acid sequence
GSSTGAVTTSNYAN

SEQ ID NO: 1484 - DNA, 42 bp, Artificial Sequence; identical to SEQ ID NO: 204
  Description of Artificial Sequence: Synthetic Light chain variable region CDR L1 nucleic acid sequence

SEQ ID NO: 1485 - protein, 7 aa, Artificial Sequence
  Description of Artificial Sequence: Synthetic Light chain variable region CDR L2 amino acid sequence
GTDKRAP

SEQ ID NO: 1486 - DNA, 21 bp, Artificial Sequence
  Description of Artificial Sequence: Synthetic Light chain variable region CDR L2 nucleic acid sequence
ggcacagacaagcgcgctcct

SEQ ID NO: 1487 - protein, 9 aa, Artificial Sequence
  Description of Artificial Sequence: Synthetic Light chain variable region CDR L3 amino acid sequence
ALWYSDLWV

SEQ ID NO: 1488 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1489 - DNA, 375 bp, Artificial Sequence; identical to SEQ ID NO: 1105
  Description of Artificial Sequence: Synthetic Heavy chain variable region nucleic acid sequence

SEQ ID NO: 1490 - protein, 125 aa, Artificial Sequence; identical to SEQ ID NO: 482
  Description of Artificial Sequence: Synthetic Heavy chain variable region amino acid sequence

SEQ ID NO: 1491 - protein, 9 aa, Artificial Sequence
  Description of Artificial Sequence: Synthetic Heavy chain variable region CDR H1 amino acid sequence
FTFDTYAMN

SEQ ID NO: 1492 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1493 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1494 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1495 - protein, 16 aa, Artificial Sequence
  Description of Artificial Sequence: Synthetic Heavy chain variable region CDR H3 amino acid sequence
VRHGNFGEGYVSWFAH

SEQ ID NO: 1496 - DNA, 48 bp, Artificial Sequence; identical to SEQ ID NO: 472
  Description of Artificial Sequence: Synthetic Heavy chain variable region CDR H3 nucleic acid sequence

SEQ ID NO: 1497 - DNA, 327 bp, Artificial Sequence; identical to SEQ ID NO: 425
  Description of Artificial Sequence: Synthetic Light chain variable region nucleic acid sequence

SEQ ID NO: 1498 - protein, 109 aa, Artificial Sequence; identical to SEQ ID NO: 426
  Description of Artificial Sequence: Synthetic Light chain variable region amino acid sequence

SEQ ID NO: 1499 - protein, 14 aa, Artificial Sequence
  Description of Artificial Sequence: Synthetic Light chain variable region CDR L1 amino acid sequence
GSSTGAVTTSNYAN

SEQ ID NO: 1500 - DNA, 42 bp, Artificial Sequence; identical to SEQ ID NO: 204
  Description of Artificial Sequence: Synthetic Light chain variable region CDR L1 nucleic acid sequence

SEQ ID NO: 1501 - protein, 7 aa, Artificial Sequence
  Description of Artificial Sequence: Synthetic Light chain variable region CDR L2 amino acid sequence
GTDKRAP

SEQ ID NO: 1502 - DNA, 21 bp, Artificial Sequence
  Description of Artificial Sequence: Synthetic Light chain variable region CDR L2 nucleic acid sequence
ggcacagacaagcgcgctcct

SEQ ID NO: 1503 - protein, 9 aa, Artificial Sequence
  Description of Artificial Sequence: Synthetic Light chain variable region CDR L3 amino acid sequence
ALWYSDLWV

SEQ ID NO: 1504 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1505 - DNA, 375 bp, Artificial Sequence; identical to SEQ ID NO: 1121
  Description of Artificial Sequence: Synthetic Heavy chain variable region nucleic acid sequence

SEQ ID NO: 1506 - protein, 125 aa, Artificial Sequence; identical to SEQ ID NO: 1122
  Description of Artificial Sequence: Synthetic Heavy chain variable region amino acid sequence

SEQ ID NO: 1507 - protein, 9 aa, Artificial Sequence
  Description of Artificial Sequence: Synthetic Heavy chain variable region CDR H1 amino acid sequence
FTFDTYAMN

SEQ ID NO: 1508 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1509 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1510 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1511 - protein, 16 aa, Artificial Sequence
  Description of Artificial Sequence: Synthetic Heavy chain variable region CDR H3 amino acid sequence
VRHDNFGAGYVSWFAH

SEQ ID NO: 1512 - DNA, 48 bp, Artificial Sequence; identical to SEQ ID NO: 1128
  Description of Artificial Sequence: Synthetic Heavy chain variable region CDR H3 nucleic acid sequence

SEQ ID NO: 1513 - DNA, 327 bp, Artificial Sequence; identical to SEQ ID NO: 425
  Description of Artificial Sequence: Synthetic Light chain variable region nucleic acid sequence

SEQ ID NO: 1514 - protein, 109 aa, Artificial Sequence; identical to SEQ ID NO: 426
  Description of Artificial Sequence: Synthetic Light chain variable region amino acid sequence

SEQ ID NO: 1515 - protein, 14 aa, Artificial Sequence
  Description of Artificial Sequence: Synthetic Light chain variable region CDR L1 amino acid sequence
GSSTGAVTTSNYAN

SEQ ID NO: 1516 - DNA, 42 bp, Artificial Sequence; identical to SEQ ID NO: 204
  Description of Artificial Sequence: Synthetic Light chain variable region CDR L1 nucleic acid sequence

SEQ ID NO: 1517 - protein, 7 aa, Artificial Sequence
  Description of Artificial Sequence: Synthetic Light chain variable region CDR L2 amino acid sequence
GTDKRAP

SEQ ID NO: 1518 - DNA, 21 bp, Artificial Sequence
  Description of Artificial Sequence: Synthetic Light chain variable region CDR L2 nucleic acid sequence
ggcacagacaagcgcgctcct

SEQ ID NO: 1519 - protein, 9 aa, Artificial Sequence
  Description of Artificial Sequence: Synthetic Light chain variable region CDR L3 amino acid sequence
ALWYSDLWV

SEQ ID NO: 1520 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1521 - DNA, 375 bp, Artificial Sequence; identical to SEQ ID NO: 1137
  Description of Artificial Sequence: Synthetic Heavy chain variable region nucleic acid sequence

SEQ ID NO: 1522 - protein, 125 aa, Artificial Sequence; identical to SEQ ID NO: 1138
  Description of Artificial Sequence: Synthetic Heavy chain variable region amino acid sequence

SEQ ID NO: 1523 - protein, 9 aa, Artificial Sequence
  Description of Artificial Sequence: Synthetic Heavy chain variable region CDR H1 amino acid sequence
FTFDTYAMN

SEQ ID NO: 1524 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1525 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1526 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1527 - protein, 16 aa, Artificial Sequence
  Description of Artificial Sequence: Synthetic Heavy chain variable region CDR H3 amino acid sequence
VRHGNFGVGYVSWFAS

SEQ ID NO: 1528 - DNA, 48 bp, Artificial Sequence; identical to SEQ ID NO: 1144
  Description of Artificial Sequence: Synthetic Heavy chain variable region CDR H3 nucleic acid sequence

SEQ ID NO: 1529 - DNA, 327 bp, Artificial Sequence; identical to SEQ ID NO: 425
  Description of Artificial Sequence: Synthetic Light chain variable region nucleic acid sequence

SEQ ID NO: 1530 - protein, 109 aa, Artificial Sequence; identical to SEQ ID NO: 426
  Description of Artificial Sequence: Synthetic Light chain variable region amino acid sequence

SEQ ID NO: 1531 - protein, 14 aa, Artificial Sequence
  Description of Artificial Sequence: Synthetic Light chain variable region CDR L1 amino acid sequence
GSSTGAVTTSNYAN

SEQ ID NO: 1532 - DNA, 42 bp, Artificial Sequence; identical to SEQ ID NO: 204
  Description of Artificial Sequence: Synthetic Light chain variable region CDR L1 nucleic acid sequence

SEQ ID NO: 1533 - protein, 7 aa, Artificial Sequence
  Description of Artificial Sequence: Synthetic Light chain variable region CDR L2 amino acid sequence
GTDKRAP

SEQ ID NO: 1534 - DNA, 21 bp, Artificial Sequence
  Description of Artificial Sequence: Synthetic Light chain variable region CDR L2 nucleic acid sequence
ggcacagacaagcgcgctcct

SEQ ID NO: 1535 - protein, 9 aa, Artificial Sequence
  Description of Artificial Sequence: Synthetic Light chain variable region CDR L3 amino acid sequence
ALWYSDLWV

SEQ ID NO: 1536 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1537 - DNA, 375 bp, Artificial Sequence; identical to SEQ ID NO: 1313
  Description of Artificial Sequence: Synthetic Heavy chain variable region nucleic acid sequence

SEQ ID NO: 1538 - protein, 125 aa, Artificial Sequence; identical to SEQ ID NO: 1314
  Description of Artificial Sequence: Synthetic Heavy chain variable region amino acid sequence

SEQ ID NO: 1539 - protein, 9 aa, Artificial Sequence
  Description of Artificial Sequence: Synthetic Heavy chain variable region CDR H1 amino acid sequence
FTFDTYAMN

SEQ ID NO: 1540 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1541 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1542 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1543 - protein, 16 aa, Artificial Sequence
  Description of Artificial Sequence: Synthetic Heavy chain variable region CDR H3 amino acid sequence
VRHGNFGGAYVSWFAH

SEQ ID NO: 1544 - DNA, 48 bp, Artificial Sequence; identical to SEQ ID NO: 1208
  Description of Artificial Sequence: Synthetic Heavy chain variable region CDR H3 nucleic acid sequence

SEQ ID NO: 1545 - DNA, 327 bp, Artificial Sequence; identical to SEQ ID NO: 425
  Description of Artificial Sequence: Synthetic Light chain variable region nucleic acid sequence

SEQ ID NO: 1546 - protein, 109 aa, Artificial Sequence; identical to SEQ ID NO: 426
  Description of Artificial Sequence: Synthetic Light chain variable region amino acid sequence

SEQ ID NO: 1547 - protein, 14 aa, Artificial Sequence
  Description of Artificial Sequence: Synthetic Light chain variable region CDR L1 amino acid sequence
GSSTGAVTTSNYAN

SEQ ID NO: 1548 - DNA, 42 bp, Artificial Sequence; identical to SEQ ID NO: 204
  Description of Artificial Sequence: Synthetic Light chain variable region CDR L1 nucleic acid sequence

SEQ ID NO: 1549 - protein, 7 aa, Artificial Sequence
  Description of Artificial Sequence: Synthetic Light chain variable region CDR L2 amino acid sequence
GTDKRAP

SEQ ID NO: 1550 - DNA, 21 bp, Artificial Sequence
  Description of Artificial Sequence: Synthetic Light chain variable region CDR L2 nucleic acid sequence
ggcacagacaagcgcgctcct

SEQ ID NO: 1551 - protein, 9 aa, Artificial Sequence
  Description of Artificial Sequence: Synthetic Light chain variable region CDR L3 amino acid sequence
ALWYSDLWV

SEQ ID NO: 1552 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1553 - DNA, 375 bp, Artificial Sequence; identical to SEQ ID NO: 1153
  Description of Artificial Sequence: Synthetic Heavy chain variable region nucleic acid sequence

SEQ ID NO: 1554 - protein, 125 aa, Artificial Sequence; identical to SEQ ID NO: 1154
  Description of Artificial Sequence: Synthetic Heavy chain variable region amino acid sequence

SEQ ID NO: 1555 - protein, 9 aa, Artificial Sequence
  Description of Artificial Sequence: Synthetic Heavy chain variable region CDR H1 amino acid sequence
FTFDTYAMN

SEQ ID NO: 1556 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1557 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1558 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1559 - protein, 16 aa, Artificial Sequence
  Description of Artificial Sequence: Synthetic Heavy chain variable region CDR H3 amino acid sequence
VRHGNFGEGYVSWFAH

SEQ ID NO: 1560 - DNA, 48 bp, Artificial Sequence; identical to SEQ ID NO: 472
  Description of Artificial Sequence: Synthetic Heavy chain variable region CDR H3 nucleic acid sequence

SEQ ID NO: 1561 - DNA, 327 bp, Artificial Sequence; identical to SEQ ID NO: 425
  Description of Artificial Sequence: Synthetic Light chain variable region nucleic acid sequence

SEQ ID NO: 1562 - protein, 109 aa, Artificial Sequence; identical to SEQ ID NO: 426
  Description of Artificial Sequence: Synthetic Light chain variable region amino acid sequence

SEQ ID NO: 1563 - protein, 14 aa, Artificial Sequence
  Description of Artificial Sequence: Synthetic Light chain variable region CDR L1 amino acid sequence
GSSTGAVTTSNYAN

SEQ ID NO: 1564 - DNA, 42 bp, Artificial Sequence; identical to SEQ ID NO: 204
  Description of Artificial Sequence: Synthetic Light chain variable region CDR L1 nucleic acid sequence

SEQ ID NO: 1565 - protein, 7 aa, Artificial Sequence
  Description of Artificial Sequence: Synthetic Light chain variable region CDR L2 amino acid sequence
GTDKRAP

SEQ ID NO: 1566 - DNA, 21 bp, Artificial Sequence
  Description of Artificial Sequence: Synthetic Light chain variable region CDR L2 nucleic acid sequence
ggcacagacaagcgcgctcct

SEQ ID NO: 1567 - protein, 9 aa, Artificial Sequence
  Description of Artificial Sequence: Synthetic Light chain variable region CDR L3 amino acid sequence
ALWYSDLWV

SEQ ID NO: 1568 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1569 - DNA, 375 bp, Artificial Sequence; identical to SEQ ID NO: 1169
  Description of Artificial Sequence: Synthetic Heavy chain variable region nucleic acid sequence

SEQ ID NO: 1570 - protein, 125 aa, Artificial Sequence; identical to SEQ ID NO: 1170
  Description of Artificial Sequence: Synthetic Heavy chain variable region amino acid sequence

SEQ ID NO: 1571 - protein, 9 aa, Artificial Sequence
  Description of Artificial Sequence: Synthetic Heavy chain variable region CDR H1 amino acid sequence
FTFDTYAMN

SEQ ID NO: 1572 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1573 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1574 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1575 - protein, 16 aa, Artificial Sequence
  Description of Artificial Sequence: Synthetic Heavy chain variable region CDR H3 amino acid sequence
VRHDNFGAGYVSWFAH

SEQ ID NO: 1576 - DNA, 48 bp, Artificial Sequence; identical to SEQ ID NO: 1128
  Description of Artificial Sequence: Synthetic Heavy chain variable region CDR H3 nucleic acid sequence

SEQ ID NO: 1577 - DNA, 327 bp, Artificial Sequence; identical to SEQ ID NO: 425
  Description of Artificial Sequence: Synthetic Light chain variable region nucleic acid sequence

SEQ ID NO: 1578 - protein, 109 aa, Artificial Sequence; identical to SEQ ID NO: 426
  Description of Artificial Sequence: Synthetic Light chain variable region amino acid sequence

SEQ ID NO: 1579 - protein, 14 aa, Artificial Sequence
  Description of Artificial Sequence: Synthetic Light chain variable region CDR L1 amino acid sequence
GSSTGAVTTSNYAN

SEQ ID NO: 1580 - DNA, 42 bp, Artificial Sequence; identical to SEQ ID NO: 204
  Description of Artificial Sequence: Synthetic Light chain variable region CDR L1 nucleic acid sequence

SEQ ID NO: 1581 - protein, 7 aa, Artificial Sequence
  Description of Artificial Sequence: Synthetic Light chain variable region CDR L2 amino acid sequence
GTDKRAP

SEQ ID NO: 1582 - DNA, 21 bp, Artificial Sequence
  Description of Artificial Sequence: Synthetic Light chain variable region CDR L2 nucleic acid sequence
ggcacagacaagcgcgctcct

SEQ ID NO: 1583 - protein, 9 aa, Artificial Sequence
  Description of Artificial Sequence: Synthetic Light chain variable region CDR L3 amino acid sequence
ALWYSDLWV

SEQ ID NO: 1584 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1585 - DNA, 375 bp, Artificial Sequence; identical to SEQ ID NO: 1185
  Description of Artificial Sequence: Synthetic Heavy chain variable region nucleic acid sequence

SEQ ID NO: 1586 - protein, 125 aa, Artificial Sequence; identical to SEQ ID NO: 1186
  Description of Artificial Sequence: Synthetic Heavy chain variable region amino acid sequence

SEQ ID NO: 1587 - protein, 9 aa, Artificial Sequence
  Description of Artificial Sequence: Synthetic Heavy chain variable region CDR H1 amino acid sequence
FTFDTYAMN

SEQ ID NO: 1588 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1589 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1590 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1591 - protein, 16 aa, Artificial Sequence
  Description of Artificial Sequence: Synthetic Heavy chain variable region CDR H3 amino acid sequence
VRHGNFGVGYVSWFAS

SEQ ID NO: 1592 - DNA, 48 bp, Artificial Sequence; identical to SEQ ID NO: 1144
  Description of Artificial Sequence: Synthetic Heavy chain variable region CDR H3 nucleic acid sequence

SEQ ID NO: 1593 - DNA, 327 bp, Artificial Sequence; identical to SEQ ID NO: 425
  Description of Artificial Sequence: Synthetic Light chain variable region nucleic acid sequence

SEQ ID NO: 1594 - protein, 109 aa, Artificial Sequence; identical to SEQ ID NO: 426
  Description of Artificial Sequence: Synthetic Light chain variable region amino acid sequence

SEQ ID NO: 1595 - protein, 14 aa, Artificial Sequence
  Description of Artificial Sequence: Synthetic Light chain variable region CDR L1 amino acid sequence
GSSTGAVTTSNYAN

SEQ ID NO: 1596 - DNA, 42 bp, Artificial Sequence; identical to SEQ ID NO: 204
  Description of Artificial Sequence: Synthetic Light chain variable region CDR L1 nucleic acid sequence

SEQ ID NO: 1597 - protein, 7 aa, Artificial Sequence
  Description of Artificial Sequence: Synthetic Light chain variable region CDR L2 amino acid sequence
GTDKRAP

SEQ ID NO: 1598 - DNA, 21 bp, Artificial Sequence
  Description of Artificial Sequence: Synthetic Light chain variable region CDR L2 nucleic acid sequence
ggcacagacaagcgcgctcct

SEQ ID NO: 1599 - protein, 9 aa, Artificial Sequence
  Description of Artificial Sequence: Synthetic Light chain variable region CDR L3 amino acid sequence
ALWYSDLWV

SEQ ID NO: 1600 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1601 - DNA, 375 bp, Artificial Sequence; identical to SEQ ID NO: 1201
  Description of Artificial Sequence: Synthetic Heavy chain variable region nucleic acid sequence

SEQ ID NO: 1602 - protein, 125 aa, Artificial Sequence; identical to SEQ ID NO: 1202
  Description of Artificial Sequence: Synthetic Heavy chain variable region amino acid sequence

SEQ ID NO: 1603 - protein, 9 aa, Artificial Sequence
  Description of Artificial Sequence: Synthetic Heavy chain variable region CDR H1 amino acid sequence
FTFDTYAMN

SEQ ID NO: 1604 - DNA, 27 bp, Artificial Sequence
  Description of Artificial Sequence: Synthetic Heavy chain variable region CDR H1 nucleic acid sequence
ttcacctttgacacatatgccatgaac

SEQ ID NO: 1605 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1606 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1607 - protein, 16 aa, Artificial Sequence
  Description of Artificial Sequence: Synthetic Heavy chain variable region CDR H3 amino acid sequence
VRHGNFGGAYVSWFAH

SEQ ID NO: 1608 - DNA, 48 bp, Artificial Sequence; identical to SEQ ID NO: 1208
  Description of Artificial Sequence: Synthetic Heavy chain variable region CDR H3 nucleic acid sequence

SEQ ID NO: 1609 - DNA, 327 bp, Artificial Sequence; identical to SEQ ID NO: 425
  Description of Artificial Sequence: Synthetic Light chain variable region nucleic acid sequence

SEQ ID NO: 1610 - protein, 109 aa, Artificial Sequence; identical to SEQ ID NO: 426
  Description of Artificial Sequence: Synthetic Light chain variable region amino acid sequence

SEQ ID NO: 1611 - protein, 14 aa, Artificial Sequence
  Description of Artificial Sequence: Synthetic Light chain variable region CDR L1 amino acid sequence
GSSTGAVTTSNYAN

SEQ ID NO: 1612 - DNA, 42 bp, Artificial Sequence; identical to SEQ ID NO: 204
  Description of Artificial Sequence: Synthetic Light chain variable region CDR L1 nucleic acid sequence

SEQ ID NO: 1613 - protein, 7 aa, Artificial Sequence
  Description of Artificial Sequence: Synthetic Light chain variable region CDR L2 amino acid sequence
GTDKRAP

SEQ ID NO: 1614 - DNA, 21 bp, Artificial Sequence
  Description of Artificial Sequence: Synthetic Light chain variable region CDR L2 nucleic acid sequence
ggcacagacaagcgcgctcct

SEQ ID NO: 1615 - protein, 9 aa, Artificial Sequence
  Description of Artificial Sequence: Synthetic Light chain variable region CDR L3 amino acid sequence
ALWYSDLWV

SEQ ID NO: 1616 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1617 - DNA, 375 bp, Artificial Sequence; identical to SEQ ID NO: 1217
  Description of Artificial Sequence: Synthetic Heavy chain variable region nucleic acid sequence

SEQ ID NO: 1618 - protein, 125 aa, Artificial Sequence; identical to SEQ ID NO: 1218
  Description of Artificial Sequence: Synthetic Heavy chain variable region amino acid sequence

SEQ ID NO: 1619 - protein, 9 aa, Artificial Sequence
  Description of Artificial Sequence: Synthetic Heavy chain variable region CDR H1 amino acid sequence
FTFDAYAMN

SEQ ID NO: 1620 - DNA, 27 bp, Artificial Sequence
  Description of Artificial Sequence: Synthetic Heavy chain variable region CDR H1 nucleic acid sequence
ttcacctttgacgcttatgccatgaac

SEQ ID NO: 1621 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1622 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1623 - protein, 16 aa, Artificial Sequence
  Description of Artificial Sequence: Synthetic Heavy chain variable region CDR H3 amino acid sequence
VRHGNFGGGYVSWFGH

SEQ ID NO: 1624 - DNA, 48 bp, Artificial Sequence; identical to SEQ ID NO: 1224
  Description of Artificial Sequence: Synthetic Heavy chain variable region CDR H3 nucleic acid sequence

SEQ ID NO: 1625 - DNA, 327 bp, Artificial Sequence; identical to SEQ ID NO: 425
  Description of Artificial Sequence: Synthetic Light chain variable region nucleic acid sequence

SEQ ID NO: 1626 - protein, 109 aa, Artificial Sequence; identical to SEQ ID NO: 426
  Description of Artificial Sequence: Synthetic Light chain variable region amino acid sequence

SEQ ID NO: 1627 - protein, 14 aa, Artificial Sequence
  Description of Artificial Sequence: Synthetic Light chain variable region CDR L1 amino acid sequence
GSSTGAVTTSNYAN

SEQ ID NO: 1628 - DNA, 42 bp, Artificial Sequence; identical to SEQ ID NO: 204
  Description of Artificial Sequence: Synthetic Light chain variable region CDR L1 nucleic acid sequence

SEQ ID NO: 1629 - protein, 7 aa, Artificial Sequence
  Description of Artificial Sequence: Synthetic Light chain variable region CDR L2 amino acid sequence
GTDKRAP

SEQ ID NO: 1630 - DNA, 21 bp, Artificial Sequence
  Description of Artificial Sequence: Synthetic Light chain variable region CDR L2 nucleic acid sequence
ggcacagacaagcgcgctcct

SEQ ID NO: 1631 - protein, 9 aa, Artificial Sequence
  Description of Artificial Sequence: Synthetic Light chain variable region CDR L3 amino acid sequence
ALWYSDLWV

SEQ ID NO: 1632 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1633 - DNA, 375 bp, Artificial Sequence; identical to SEQ ID NO: 1409
  Description of Artificial Sequence: Synthetic Heavy chain variable region nucleic acid sequence

SEQ ID NO: 1634 - protein, 125 aa, Artificial Sequence; identical to SEQ ID NO: 1410
  Description of Artificial Sequence: Synthetic Heavy chain variable region amino acid sequence

SEQ ID NO: 1635 - protein, 9 aa, Artificial Sequence
  Description of Artificial Sequence: Synthetic Heavy chain variable region CDR H1 amino acid sequence
FTFDAYAMN

SEQ ID NO: 1636 - DNA, 27 bp, Artificial Sequence
  Description of Artificial Sequence: Synthetic Heavy chain variable region CDR H1 nucleic acid sequence
ttcacctttgacgcttatgccatgaac

SEQ ID NO: 1637 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1638 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1639 - protein, 16 aa, Artificial Sequence
  Description of Artificial Sequence: Synthetic Heavy chain variable region CDR H3 amino acid sequence
VRHGNVGGGYVSWFAH

SEQ ID NO: 1640 - DNA, 48 bp, Artificial Sequence; identical to SEQ ID NO: 1416
  Description of Artificial Sequence: Synthetic Heavy chain variable region CDR H3 nucleic acid sequence

SEQ ID NO: 1641 - DNA, 327 bp, Artificial Sequence; identical to SEQ ID NO: 425
  Description of Artificial Sequence: Synthetic Light chain variable region nucleic acid sequence

SEQ ID NO: 1642 - protein, 109 aa, Artificial Sequence; identical to SEQ ID NO: 426
  Description of Artificial Sequence: Synthetic Light chain variable region amino acid sequence

SEQ ID NO: 1643 - protein, 14 aa, Artificial Sequence
  Description of Artificial Sequence: Synthetic Light chain variable region CDR L1 amino acid sequence
GSSTGAVTTSNYAN

SEQ ID NO: 1644 - DNA, 42 bp, Artificial Sequence; identical to SEQ ID NO: 204
  Description of Artificial Sequence: Synthetic Light chain variable region CDR L1 nucleic acid sequence

SEQ ID NO: 1645 - protein, 7 aa, Artificial Sequence
  Description of Artificial Sequence: Synthetic Light chain variable region CDR L2 amino acid sequence
GTDKRAP

SEQ ID NO: 1646 - DNA, 21 bp, Artificial Sequence
  Description of Artificial Sequence: Synthetic Light chain variable region CDR L2 nucleic acid sequence
ggcacagacaagcgcgctcct

SEQ ID NO: 1647 - protein, 9 aa, Artificial Sequence
  Description of Artificial Sequence: Synthetic Light chain variable region CDR L3 amino acid sequence
ALWYSDLWV

SEQ ID NO: 1648 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1649 - DNA, 375 bp, Artificial Sequence; identical to SEQ ID NO: 1233
  Description of Artificial Sequence: Synthetic Heavy chain variable region nucleic acid sequence

SEQ ID NO: 1650 - protein, 125 aa, Artificial Sequence; identical to SEQ ID NO: 1234
  Description of Artificial Sequence: Synthetic Heavy chain variable region amino acid sequence

SEQ ID NO: 1651 - protein, 9 aa, Artificial Sequence
  Description of Artificial Sequence: Synthetic Heavy chain variable region CDR H1 amino acid sequence
FTFDAYAMN

SEQ ID NO: 1652 - DNA, 27 bp, Artificial Sequence
  Description of Artificial Sequence: Synthetic Heavy chain variable region CDR H1 nucleic acid sequence
ttcacctttgacgcttatgccatgaac

SEQ ID NO: 1653 - protein, 19 aa, Artificial Sequence
  Description of Artificial Sequence: Synthetic Heavy chain variable region CDR H2 amino acid sequence
RIRSKYNDYATYYADSVKD

SEQ ID NO: 1654 - DNA, 57 bp, Artificial Sequence; identical to SEQ ID NO: 422
  Description of Artificial Sequence: Synthetic Heavy chain variable region CDR H2 nucleic acid sequence

SEQ ID NO: 1655 - protein, 16 aa, Artificial Sequence
  Description of Artificial Sequence: Synthetic Heavy chain variable region CDR H3 amino acid sequence
VRHGNFGNYAVSWFAH

SEQ ID NO: 1656 - DNA, 48 bp, Artificial Sequence; identical to SEQ ID NO: 1240
  Description of Artificial Sequence: Synthetic Heavy chain variable region CDR H3 nucleic acid sequence

SEQ ID NO: 1657 - DNA, 327 bp, Artificial Sequence; identical to SEQ ID NO: 425
  Description of Artificial Sequence: Synthetic Light chain variable region nucleic acid sequence

SEQ ID NO: 1658 - protein, 109 aa, Artificial Sequence; identical to SEQ ID NO: 426
  Description of Artificial Sequence: Synthetic Light chain variable region amino acid sequence

SEQ ID NO: 1659 - protein, 14 aa, Artificial Sequence
  Description of Artificial Sequence: Synthetic Light chain variable region CDR L1 amino acid sequence
GSSTGAVTTSNYAN

SEQ ID NO: 1660 - DNA, 42 bp, Artificial Sequence; identical to SEQ ID NO: 204
  Description of Artificial Sequence: Synthetic Light chain variable region CDR L1 nucleic acid sequence

SEQ ID NO: 1661 - protein, 7 aa, Artificial Sequence
  Description of Artificial Sequence: Synthetic Light chain variable region CDR L2 amino acid sequence
GTDKRAP

SEQ ID NO: 1662 - DNA, 21 bp, Artificial Sequence
  Description of Artificial Sequence: Synthetic Light chain variable region CDR L2 nucleic acid sequence
ggcacagacaagcgcgctcct

SEQ ID NO: 1663 - protein, 9 aa, Artificial Sequence
  Description of Artificial Sequence: Synthetic Light chain variable region CDR L3 amino acid sequence
ALWYSDLWV

SEQ ID NO: 1664 - DNA, 27 bp, Artificial Sequence
  Description of Artificial Sequence: Synthetic Light chain variable region CDR L3 nucleic acid sequence
gcgctgtggtacagtgatctgtgggtg

SEQ ID NO: 1665 - DNA, 375 bp, Artificial Sequence; identical to SEQ ID NO: 17
  Description of Artificial Sequence: Synthetic Heavy chain variable region nucleic acid sequence

SEQ ID NO: 1666 - protein, 125 aa, Artificial Sequence; identical to SEQ ID NO: 18
  Description of Artificial Sequence: Synthetic Heavy chain variable region amino acid sequence

SEQ ID NO: 1667 - protein, 9 aa, Artificial Sequence
  Description of Artificial Sequence: Synthetic Heavy chain variable region CDR H1 amino acid sequence
FTFDTYAMN

SEQ ID NO: 1668 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1669 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1670 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1671 - protein, 16 aa, Artificial Sequence
  Description of Artificial Sequence: Synthetic Heavy chain variable region CDR H3 amino acid sequence
VRHGNFGNGYVSWFAH

SEQ ID NO: 1672 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1673 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcatcatcacgggggcccaggcagatgatgaagctgattattactgtgcgctgtggtacagtaacctttgggtgttcggcggagggaccaagctgaccgtccta

SEQ ID NO: 1674 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALIITGAQADDEADYYCALWYSNLWVFGGGTKLTVL

SEQ ID NO: 1675 - protein, 14 aa, Artificial Sequence
  Description of Artificial Sequence: Synthetic Light chain variable region CDR L1 amino acid sequence
GSSTGAVTTSNYAN

SEQ ID NO: 1676 - DNA, 42 bp, Artificial Sequence; identical to SEQ ID NO: 204
  Description of Artificial Sequence: Synthetic Light chain variable region CDR L1 nucleic acid sequence

SEQ ID NO: 1677 - protein, 7 aa, Artificial Sequence
  Description of Artificial Sequence: Synthetic Light chain variable region CDR L2 amino acid sequence
GTDKRAP

SEQ ID NO: 1678 - DNA, 21 bp, Artificial Sequence
  Description of Artificial Sequence: Synthetic Light chain variable region CDR L2 nucleic acid sequence
ggcacagacaagcgcgctcct

SEQ ID NO: 1679 - protein, 9 aa, Artificial Sequence
  Description of Artificial Sequence: Synthetic Light chain variable region CDR L3 amino acid sequence
ALWYSNLWV

SEQ ID NO: 1680 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1681 - DNA, 375 bp, Artificial Sequence; identical to SEQ ID NO: 17
  Description of Artificial Sequence: Synthetic Heavy chain variable region nucleic acid sequence

SEQ ID NO: 1682 - protein, 125 aa, Artificial Sequence; identical to SEQ ID NO: 18
  Description of Artificial Sequence: Synthetic Heavy chain variable region amino acid sequence

SEQ ID NO: 1683 - protein, 9 aa, Artificial Sequence
  Description of Artificial Sequence: Synthetic Heavy chain variable region CDR H1 amino acid sequence
FTFDTYAMN

SEQ ID NO: 1684 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1685 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1686 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1687 - protein, 16 aa, Artificial Sequence
  Description of Artificial Sequence: Synthetic Heavy chain variable region CDR H3 amino acid sequence
VRHGNFGNGYVSWFAH

SEQ ID NO: 1688 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1689 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcatcatcacgggggcccaggcagaggatgaagctgattattactgtgcgctgtggtacagtaacctttgggtgttcggcggagggaccaagctgaccgtccta

SEQ ID NO: 1690 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALIITGAQAEDEADYYCALWYSNLWVFGGGTKLTVL

SEQ ID NO: 1691 - protein, 14 aa, Artificial Sequence
  Description of Artificial Sequence: Synthetic Light chain variable region CDR L1 amino acid sequence
GSSTGAVTTSNYAN

SEQ ID NO: 1692 - DNA, 42 bp, Artificial Sequence; identical to SEQ ID NO: 204
  Description of Artificial Sequence: Synthetic Light chain variable region CDR L1 nucleic acid sequence

SEQ ID NO: 1693 - protein, 7 aa, Artificial Sequence
  Description of Artificial Sequence: Synthetic Light chain variable region CDR L2 amino acid sequence
GTDKRAP

SEQ ID NO: 1694 - DNA, 21 bp, Artificial Sequence
  Description of Artificial Sequence: Synthetic Light chain variable region CDR L2 nucleic acid sequence
ggcacagacaagcgcgctcct

SEQ ID NO: 1695 - protein, 9 aa, Artificial Sequence
  Description of Artificial Sequence: Synthetic Light chain variable region CDR L3 amino acid sequence
ALWYSNLWV

SEQ ID NO: 1696 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1697 - DNA, 375 bp, Artificial Sequence; identical to SEQ ID NO: 17
  Description of Artificial Sequence: Synthetic Heavy chain variable region nucleic acid sequence

SEQ ID NO: 1698 - protein, 125 aa, Artificial Sequence; identical to SEQ ID NO: 18
  Description of Artificial Sequence: Synthetic Heavy chain variable region amino acid sequence

SEQ ID NO: 1699 - protein, 9 aa, Artificial Sequence
  Description of Artificial Sequence: Synthetic Heavy chain variable region CDR H1 amino acid sequence
FTFDTYAMN

SEQ ID NO: 1700 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1701 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1702 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1703 - protein, 16 aa, Artificial Sequence
  Description of Artificial Sequence: Synthetic Heavy chain variable region CDR H3 amino acid sequence
VRHGNFGNGYVSWFAH

SEQ ID NO: 1704 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1705 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcatcatcacgggggcccaggcagatgatgaagctgattattactgtgtgctgtggtacagtaacctttgggtgttcggcggagggaccaagctgaccgtccta

SEQ ID NO: 1706 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALIITGAQADDEADYYCVLWYSNLWVFGGGTKLTVL

SEQ ID NO: 1707 - protein, 14 aa, Artificial Sequence
  Description of Artificial Sequence: Synthetic Light chain variable region CDR L1 amino acid sequence
GSSTGAVTTSNYAN

SEQ ID NO: 1708 - DNA, 42 bp, Artificial Sequence; identical to SEQ ID NO: 204
  Description of Artificial Sequence: Synthetic Light chain variable region CDR L1 nucleic acid sequence

SEQ ID NO: 1709 - protein, 7 aa, Artificial Sequence
  Description of Artificial Sequence: Synthetic Light chain variable region CDR L2 amino acid sequence
GTDKRAP

SEQ ID NO: 1710 - DNA, 21 bp, Artificial Sequence
  Description of Artificial Sequence: Synthetic Light chain variable region CDR L2 nucleic acid sequence
ggcacagacaagcgcgctcct

SEQ ID NO: 1711 - protein, 9 aa, Artificial Sequence
  Description of Artificial Sequence: Synthetic Light chain variable region CDR L3 amino acid sequence
VLWYSNLWV

SEQ ID NO: 1712 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 1713 - DNA, 375 bp, Artificial Sequence; identical to SEQ ID NO: 17
  Description of Artificial Sequence: Synthetic Heavy chain variable region nucleic acid sequence

SEQ ID NO: 1714 - protein, 125 aa, Artificial Sequence; identical to SEQ ID NO: 18
  Description of Artificial Sequence: Synthetic Heavy chain variable region amino acid sequence

SEQ ID NO: 1715 - protein, 9 aa, Artificial Sequence
  Description of Artificial Sequence: Synthetic Heavy chain variable region CDR H1 amino acid sequence
FTFDTYAMN

SEQ ID NO: 1716 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1717 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1718 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1719 - protein, 16 aa, Artificial Sequence
  Description of Artificial Sequence: Synthetic Heavy chain variable region CDR H3 amino acid sequence
VRHGNFGNGYVSWFAH

SEQ ID NO: 1720 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1721 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggtccaggcagatgatgaagctgattattactgtgcgctgtggtacagtaacctttgggtgttcggcggagggaccaagctgaccgtccta

SEQ ID NO: 1722 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGVQADDEADYYCALWYSNLWVFGGGTKLTVL

SEQ ID NO: 1723 - protein, 14 aa, Artificial Sequence
  Description of Artificial Sequence: Synthetic Light chain variable region CDR L1 amino acid sequence
GSSTGAVTTSNYAN

SEQ ID NO: 1724 - DNA, 42 bp, Artificial Sequence; identical to SEQ ID NO: 204
  Description of Artificial Sequence: Synthetic Light chain variable region CDR L1 nucleic acid sequence

SEQ ID NO: 1725 - protein, 7 aa, Artificial Sequence
  Description of Artificial Sequence: Synthetic Light chain variable region CDR L2 amino acid sequence
GTDKRAP

SEQ ID NO: 1726 - DNA, 21 bp, Artificial Sequence
  Description of Artificial Sequence: Synthetic Light chain variable region CDR L2 nucleic acid sequence
ggcacagacaagcgcgctcct

SEQ ID NO: 1727 - protein, 9 aa, Artificial Sequence
  Description of Artificial Sequence: Synthetic Light chain variable region CDR L3 amino acid sequence
ALWYSNLWV

SEQ ID NO: 1728 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1729 - DNA, 375 bp, Artificial Sequence; identical to SEQ ID NO: 17
  Description of Artificial Sequence: Synthetic Heavy chain variable region nucleic acid sequence

SEQ ID NO: 1730 - protein, 125 aa, Artificial Sequence; identical to SEQ ID NO: 18
  Description of Artificial Sequence: Synthetic Heavy chain variable region amino acid sequence

SEQ ID NO: 1731 - protein, 9 aa, Artificial Sequence
  Description of Artificial Sequence: Synthetic Heavy chain variable region CDR H1 amino acid sequence
FTFDTYAMN

SEQ ID NO: 1732 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1733 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1734 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1735 - protein, 16 aa, Artificial Sequence
  Description of Artificial Sequence: Synthetic Heavy chain variable region CDR H3 amino acid sequence
VRHGNFGNGYVSWFAH

SEQ ID NO: 1736 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1737 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcgctggcgcagtcactactagtaactacgccaactgggtccagcagaccccaggccaggctccacgcggactcatcggcggcacagacaagcgcgctcctggggtccctgatcgcttctctggctccctgcttggggacaaagctgccctcaccatcacgggggtccaggcagatgatgaagctgattattactgtgcgctgtggtacagtaacctttgggtgttcggcggagggaccaagctgaccgtccta

SEQ ID NO: 1738 - protein, 109 aa, Artificial Sequence
  Description of Artificial Sequence: Synthetic Light chain variable region amino acid sequence
QTVVTQEPSLSVSPGGTVTLTCGSSAGAVTTSNYANWVQQTPGQAPRGLIGGTDKRAPGVPDRFSGSLLGDKAALTITGVQADDEADYYCALWYSNLWVFGGGTKLTVL

SEQ ID NO: 1739 - protein, 14 aa, Artificial Sequence
  Description of Artificial Sequence: Synthetic Light chain variable region CDR L1 amino acid sequence
GSSAGAVTTSNYAN

SEQ ID NO: 1740 - DNA, 42 bp, Artificial Sequence; identical to SEQ ID NO: 236
  Description of Artificial Sequence: Synthetic Light chain variable region CDR L1 nucleic acid sequence

SEQ ID NO: 1741 - protein, 7 aa, Artificial Sequence
  Description of Artificial Sequence: Synthetic Light chain variable region CDR L2 amino acid sequence
GTDKRAP

SEQ ID NO: 1742 - DNA, 21 bp, Artificial Sequence
  Description of Artificial Sequence: Synthetic Light chain variable region CDR L2 nucleic acid sequence
ggcacagacaagcgcgctcct

SEQ ID NO: 1743 - protein, 9 aa, Artificial Sequence
  Description of Artificial Sequence: Synthetic Light chain variable region CDR L3 amino acid sequence
ALWYSNLWV

SEQ ID NO: 1744 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1745 - DNA, 375 bp, Artificial Sequence; identical to SEQ ID NO: 17
  Description of Artificial Sequence: Synthetic Heavy chain variable region nucleic acid sequence

SEQ ID NO: 1746 - protein, 125 aa, Artificial Sequence; identical to SEQ ID NO: 18
  Description of Artificial Sequence: Synthetic Heavy chain variable region amino acid sequence

SEQ ID NO: 1747 - protein, 9 aa, Artificial Sequence
  Description of Artificial Sequence: Synthetic Heavy chain variable region CDR H1 amino acid sequence
FTFDTYAMN

SEQ ID NO: 1748 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1749 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1750 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1751 - protein, 16 aa, Artificial Sequence
  Description of Artificial Sequence: Synthetic Heavy chain variable region CDR H3 amino acid sequence
VRHGNFGNGYVSWFAH

SEQ ID NO: 1752 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1753 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggtccaggcagaggatgaagctgattattactgtgcgctgtggtacagtaacctttgggtgttcggcggagggaccaagctgaccgtccta

SEQ ID NO: 1754 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGVQAEDEADYYCALWYSNLWVFGGGTKLTVL

SEQ ID NO: 1755 - protein, 14 aa, Artificial Sequence
  Description of Artificial Sequence: Synthetic Light chain variable region CDR L1 amino acid sequence
GSSTGAVTTSNYAN

SEQ ID NO: 1756 - DNA, 42 bp, Artificial Sequence; identical to SEQ ID NO: 204
  Description of Artificial Sequence: Synthetic Light chain variable region CDR L1 nucleic acid sequence

SEQ ID NO: 1757 - protein, 7 aa, Artificial Sequence
  Description of Artificial Sequence: Synthetic Light chain variable region CDR L2 amino acid sequence
GTDKRAP

SEQ ID NO: 1758 - DNA, 21 bp, Artificial Sequence
  Description of Artificial Sequence: Synthetic Light chain variable region CDR L2 nucleic acid sequence
ggcacagacaagcgcgctcct

SEQ ID NO: 1759 - protein, 9 aa, Artificial Sequence
  Description of Artificial Sequence: Synthetic Light chain variable region CDR L3 amino acid sequence
ALWYSNLWV

SEQ ID NO: 1760 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1761 - DNA, 375 bp, Artificial Sequence; identical to SEQ ID NO: 17
  Description of Artificial Sequence: Synthetic Heavy chain variable region nucleic acid sequence

SEQ ID NO: 1762 - protein, 125 aa, Artificial Sequence; identical to SEQ ID NO: 18
  Description of Artificial Sequence: Synthetic Heavy chain variable region amino acid sequence

SEQ ID NO: 1763 - protein, 9 aa, Artificial Sequence
  Description of Artificial Sequence: Synthetic Heavy chain variable region CDR H1 amino acid sequence
FTFDTYAMN

SEQ ID NO: 1764 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1765 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1766 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1767 - protein, 16 aa, Artificial Sequence
  Description of Artificial Sequence: Synthetic Heavy chain variable region CDR H3 amino acid sequence
VRHGNFGNGYVSWFAH

SEQ ID NO: 1768 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1769 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggtccaggcagatgatgaagctgattattactgtgcgctgtggtacaataacctttgggtgttcggcggagggaccaagctgaccgtccta

SEQ ID NO: 1770 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGVQADDEADYYCALWYNNLWVFGGGTKLTVL

SEQ ID NO: 1771 - protein, 14 aa, Artificial Sequence
  Description of Artificial Sequence: Synthetic Light chain variable region CDR L1 amino acid sequence
GSSTGAVTTSNYAN

SEQ ID NO: 1772 - DNA, 42 bp, Artificial Sequence; identical to SEQ ID NO: 204
  Description of Artificial Sequence: Synthetic Light chain variable region CDR L1 nucleic acid sequence

SEQ ID NO: 1773 - protein, 7 aa, Artificial Sequence
  Description of Artificial Sequence: Synthetic Light chain variable region CDR L2 amino acid sequence
GTDKRAP

SEQ ID NO: 1774 - DNA, 21 bp, Artificial Sequence
  Description of Artificial Sequence: Synthetic Light chain variable region CDR L2 nucleic acid sequence
ggcacagacaagcgcgctcct

SEQ ID NO: 1775 - protein, 9 aa, Artificial Sequence
  Description of Artificial Sequence: Synthetic Light chain variable region CDR L3 amino acid sequence
ALWYNNLWV

SEQ ID NO: 1776 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 1777 - DNA, 375 bp, Artificial Sequence; identical to SEQ ID NO: 17
  Description of Artificial Sequence: Synthetic Heavy chain variable region nucleic acid sequence

SEQ ID NO: 1778 - protein, 125 aa, Artificial Sequence; identical to SEQ ID NO: 18
  Description of Artificial Sequence: Synthetic Heavy chain variable region amino acid sequence

SEQ ID NO: 1779 - protein, 9 aa, Artificial Sequence
  Description of Artificial Sequence: Synthetic Heavy chain variable region CDR H1 amino acid sequence
FTFDTYAMN

SEQ ID NO: 1780 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1781 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1782 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1783 - protein, 16 aa, Artificial Sequence
  Description of Artificial Sequence: Synthetic Heavy chain variable region CDR H3 amino acid sequence
VRHGNFGNGYVSWFAH

SEQ ID NO: 1784 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1785 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggtccaggcagatgatgaagctgattattactgtgtgctgtggtacagtaacctttgggtgttcggcggagggaccaagctgaccgtccta

SEQ ID NO: 1786 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGVQADDEADYYCVLWYSNLWVFGGGTKLTVL

SEQ ID NO: 1787 - protein, 14 aa, Artificial Sequence
  Description of Artificial Sequence: Synthetic Light chain variable region CDR L1 amino acid sequence
GSSTGAVTTSNYAN

SEQ ID NO: 1788 - DNA, 42 bp, Artificial Sequence; identical to SEQ ID NO: 204
  Description of Artificial Sequence: Synthetic Light chain variable region CDR L1 nucleic acid sequence

SEQ ID NO: 1789 - protein, 7 aa, Artificial Sequence
  Description of Artificial Sequence: Synthetic Light chain variable region CDR L2 amino acid sequence
GTDKRAP

SEQ ID NO: 1790 - DNA, 21 bp, Artificial Sequence
  Description of Artificial Sequence: Synthetic Light chain variable region CDR L2 nucleic acid sequence
ggcacagacaagcgcgctcct

SEQ ID NO: 1791 - protein, 9 aa, Artificial Sequence
  Description of Artificial Sequence: Synthetic Light chain variable region CDR L3 amino acid sequence
VLWYSNLWV

SEQ ID NO: 1792 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 1793 - DNA, 375 bp, Artificial Sequence; identical to SEQ ID NO: 17
  Description of Artificial Sequence: Synthetic Heavy chain variable region nucleic acid sequence

SEQ ID NO: 1794 - protein, 125 aa, Artificial Sequence; identical to SEQ ID NO: 18
  Description of Artificial Sequence: Synthetic Heavy chain variable region amino acid sequence

SEQ ID NO: 1795 - protein, 9 aa, Artificial Sequence
  Description of Artificial Sequence: Synthetic Heavy chain variable region CDR H1 amino acid sequence
FTFDTYAMN

SEQ ID NO: 1796 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1797 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1798 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1799 - protein, 16 aa, Artificial Sequence
  Description of Artificial Sequence: Synthetic Heavy chain variable region CDR H3 amino acid sequence
VRHGNFGNGYVSWFAH

SEQ ID NO: 1800 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1801 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcgctggcgcagtcactactagtaactacgccaactgggtccagcagaccccaggccaggctccacgcggactcatcggcggcacagacaagcgcgctcctggggtccctgatcgcttctctggctccctgcttggggacaaagctgccctcaccatcacgggggcccaggcagatgatgaagctgattattactgtgcgctgtggtacagtaacctttgggtgttcggcggagggaccaagctgaccgtccta

SEQ ID NO: 1802 - protein, 109 aa, Artificial Sequence
  Description of Artificial Sequence: Synthetic Light chain variable region amino acid sequence
QTVVTQEPSLSVSPGGTVTLTCGSSAGAVTTSNYANWVQQTPGQAPRGLIGGTDKRAPGVPDRFSGSLLGDKAALTITGAQADDEADYYCALWYSNLWVFGGGTKLTVL

SEQ ID NO: 1803 - protein, 14 aa, Artificial Sequence
  Description of Artificial Sequence: Synthetic Light chain variable region CDR L1 amino acid sequence
GSSAGAVTTSNYAN

SEQ ID NO: 1804 - DNA, 42 bp, Artificial Sequence; identical to SEQ ID NO: 236
  Description of Artificial Sequence: Synthetic Light chain variable region CDR L1 nucleic acid sequence

SEQ ID NO: 1805 - protein, 7 aa, Artificial Sequence
  Description of Artificial Sequence: Synthetic Light chain variable region CDR L2 amino acid sequence
GTDKRAP

SEQ ID NO: 1806 - DNA, 21 bp, Artificial Sequence
  Description of Artificial Sequence: Synthetic Light chain variable region CDR L2 nucleic acid sequence
ggcacagacaagcgcgctcct

SEQ ID NO: 1807 - protein, 9 aa, Artificial Sequence
  Description of Artificial Sequence: Synthetic Light chain variable region CDR L3 amino acid sequence
ALWYSNLWV

SEQ ID NO: 1808 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1809 - DNA, 375 bp, Artificial Sequence; identical to SEQ ID NO: 17
  Description of Artificial Sequence: Synthetic Heavy chain variable region nucleic acid sequence

SEQ ID NO: 1810 - protein, 125 aa, Artificial Sequence; identical to SEQ ID NO: 18
  Description of Artificial Sequence: Synthetic Heavy chain variable region amino acid sequence

SEQ ID NO: 1811 - protein, 9 aa, Artificial Sequence
  Description of Artificial Sequence: Synthetic Heavy chain variable region CDR H1 amino acid sequence
FTFDTYAMN

SEQ ID NO: 1812 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1813 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1814 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1815 - protein, 16 aa, Artificial Sequence
  Description of Artificial Sequence: Synthetic Heavy chain variable region CDR H3 amino acid sequence
VRHGNFGNGYVSWFAH

SEQ ID NO: 1816 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1817 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagatgatgaagctgattattactgtgcgctgtggtacaataacctttgggtgttcggcggagggaccaagctgaccgtccta

SEQ ID NO: 1818 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQADDEADYYCALWYNNLWVFGGGTKLTVL

SEQ ID NO: 1819 - protein, 14 aa, Artificial Sequence
  Description of Artificial Sequence: Synthetic Light chain variable region CDR L1 amino acid sequence
GSSTGAVTTSNYAN

SEQ ID NO: 1820 - DNA, 42 bp, Artificial Sequence; identical to SEQ ID NO: 204
  Description of Artificial Sequence: Synthetic Light chain variable region CDR L1 nucleic acid sequence

SEQ ID NO: 1821 - protein, 7 aa, Artificial Sequence
  Description of Artificial Sequence: Synthetic Light chain variable region CDR L2 amino acid sequence
GTDKRAP

SEQ ID NO: 1822 - DNA, 21 bp, Artificial Sequence
  Description of Artificial Sequence: Synthetic Light chain variable region CDR L2 nucleic acid sequence
ggcacagacaagcgcgctcct

SEQ ID NO: 1823 - protein, 9 aa, Artificial Sequence
  Description of Artificial Sequence: Synthetic Light chain variable region CDR L3 amino acid sequence
ALWYNNLWV

SEQ ID NO: 1824 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 1825 - DNA, 375 bp, Artificial Sequence; identical to SEQ ID NO: 17
  Description of Artificial Sequence: Synthetic Heavy chain variable region nucleic acid sequence

SEQ ID NO: 1826 - protein, 125 aa, Artificial Sequence; identical to SEQ ID NO: 18
  Description of Artificial Sequence: Synthetic Heavy chain variable region amino acid sequence

SEQ ID NO: 1827 - protein, 9 aa, Artificial Sequence
  Description of Artificial Sequence: Synthetic Heavy chain variable region CDR H1 amino acid sequence
FTFDTYAMN

SEQ ID NO: 1828 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1829 - protein, 19 aa, Artificial Sequence
  Description of Artificial Sequence: Synthetic Heavy chain variable region CDR H2 amino acid sequence
RIRSKYNNYATYYADSVKD

SEQ ID NO: 1830 - DNA, 57 bp, Artificial Sequence; identical to SEQ ID NO: 6
  Description of Artificial Sequence: Synthetic Heavy chain variable region CDR H2 nucleic acid sequence

SEQ ID NO: 1831 - protein, 16 aa, Artificial Sequence
  Description of Artificial Sequence: Synthetic Heavy chain variable region CDR H3 amino acid sequence
VRHGNFGNGYVSWFAH

SEQ ID NO: 1832 - DNA, 48 bp, Artificial Sequence; identical to SEQ ID NO: 24
  Description of Artificial Sequence: Synthetic Heavy chain variable region CDR H3 nucleic acid sequence

SEQ ID NO: 1833 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagatgatgaagctgattattactgtgtgctgtggtacagtaacctttgggtgttcggcggagggaccaagctgaccgtccta

SEQ ID NO: 1834 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQADDEADYYCVLWYSNLWVFGGGTKLTVL

SEQ ID NO: 1835 - protein, 14 aa, Artificial Sequence
  Description of Artificial Sequence: Synthetic Light chain variable region CDR L1 amino acid sequence
GSSTGAVTTSNYAN

SEQ ID NO: 1836 - DNA, 42 bp, Artificial Sequence; identical to SEQ ID NO: 204
  Description of Artificial Sequence: Synthetic Light chain variable region CDR L1 nucleic acid sequence

SEQ ID NO: 1837 - protein, 7 aa, Artificial Sequence
  Description of Artificial Sequence: Synthetic Light chain variable region CDR L2 amino acid sequence
GTDKRAP

SEQ ID NO: 1838 - DNA, 21 bp, Artificial Sequence
  Description of Artificial Sequence: Synthetic Light chain variable region CDR L2 nucleic acid sequence
ggcacagacaagcgcgctcct

SEQ ID NO: 1839 - protein, 9 aa, Artificial Sequence
  Description of Artificial Sequence: Synthetic Light chain variable region CDR L3 amino acid sequence
VLWYSNLWV

SEQ ID NO: 1840 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 1841 - DNA, 375 bp, Artificial Sequence; identical to SEQ ID NO: 65
  Description of Artificial Sequence: Synthetic Heavy chain variable region nucleic acid sequence

SEQ ID NO: 1842 - protein, 125 aa, Artificial Sequence; identical to SEQ ID NO: 66
  Description of Artificial Sequence: Synthetic Heavy chain variable region amino acid sequence

SEQ ID NO: 1843 - protein, 9 aa, Artificial Sequence
  Description of Artificial Sequence: Synthetic Heavy chain variable region CDR H1 amino acid sequence
FTFDTYAMN

SEQ ID NO: 1844 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1845 - protein, 19 aa, Artificial Sequence
  Description of Artificial Sequence: Synthetic Heavy chain variable region CDR H2 amino acid sequence
RIRSKYNNYATYYADSVKG

SEQ ID NO: 1846 - DNA, 57 bp, Artificial Sequence; identical to SEQ ID NO: 70
  Description of Artificial Sequence: Synthetic Heavy chain variable region CDR H2 nucleic acid sequence

SEQ ID NO: 1847 - protein, 16 aa, Artificial Sequence
  Description of Artificial Sequence: Synthetic Heavy chain variable region CDR H3 amino acid sequence
VRHGNFGNSYVSWFAH

SEQ ID NO: 1848 - DNA, 48 bp, Artificial Sequence; identical to SEQ ID NO: 72
  Description of Artificial Sequence: Synthetic Heavy chain variable region CDR H3 nucleic acid sequence

SEQ ID NO: 1849 - DNA, 327 bp, Artificial Sequence; identical to SEQ ID NO: 1673
  Description of Artificial Sequence: Synthetic Light chain variable region nucleic acid sequence

SEQ ID NO: 1850 - protein, 109 aa, Artificial Sequence; identical to SEQ ID NO: 1674
  Description of Artificial Sequence: Synthetic Light chain variable region amino acid sequence

SEQ ID NO: 1851 - protein, 14 aa, Artificial Sequence
  Description of Artificial Sequence: Synthetic Light chain variable region CDR L1 amino acid sequence
GSSTGAVTTSNYAN

SEQ ID NO: 1852 - DNA, 42 bp, Artificial Sequence; identical to SEQ ID NO: 204
  Description of Artificial Sequence: Synthetic Light chain variable region CDR L1 nucleic acid sequence

SEQ ID NO: 1853 - protein, 7 aa, Artificial Sequence
  Description of Artificial Sequence: Synthetic Light chain variable region CDR L2 amino acid sequence
GTDKRAP

SEQ ID NO: 1854 - DNA, 21 bp, Artificial Sequence
  Description of Artificial Sequence: Synthetic Light chain variable region CDR L2 nucleic acid sequence
ggcacagacaagcgcgctcct

SEQ ID NO: 1855 - protein, 9 aa, Artificial Sequence
  Description of Artificial Sequence: Synthetic Light chain variable region CDR L3 amino acid sequence
ALWYSNLWV

SEQ ID NO: 1856 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1857 - DNA, 375 bp, Artificial Sequence; identical to SEQ ID NO: 65
  Description of Artificial Sequence: Synthetic Heavy chain variable region nucleic acid sequence

SEQ ID NO: 1858 - protein, 125 aa, Artificial Sequence; identical to SEQ ID NO: 66
  Description of Artificial Sequence: Synthetic Heavy chain variable region amino acid sequence

SEQ ID NO: 1859 - protein, 9 aa, Artificial Sequence
  Description of Artificial Sequence: Synthetic Heavy chain variable region CDR H1 amino acid sequence
FTFDTYAMN

SEQ ID NO: 1860 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1861 - protein, 19 aa, Artificial Sequence
  Description of Artificial Sequence: Synthetic Heavy chain variable region CDR H2 amino acid sequence
RIRSKYNNYATYYADSVKG

SEQ ID NO: 1862 - DNA, 57 bp, Artificial Sequence; identical to SEQ ID NO: 70
  Description of Artificial Sequence: Synthetic Heavy chain variable region CDR H2 nucleic acid sequence

SEQ ID NO: 1863 - protein, 16 aa, Artificial Sequence
  Description of Artificial Sequence: Synthetic Heavy chain variable region CDR H3 amino acid sequence
VRHGNFGNSYVSWFAH

SEQ ID NO: 1864 - DNA, 48 bp, Artificial Sequence; identical to SEQ ID NO: 72
  Description of Artificial Sequence: Synthetic Heavy chain variable region CDR H3 nucleic acid sequence

SEQ ID NO: 1865 - DNA, 327 bp, Artificial Sequence; identical to SEQ ID NO: 1689
  Description of Artificial Sequence: Synthetic Light chain variable region nucleic acid sequence

SEQ ID NO: 1866 - protein, 109 aa, Artificial Sequence; identical to SEQ ID NO: 1690
  Description of Artificial Sequence: Synthetic Light chain variable region amino acid sequence

SEQ ID NO: 1867 - protein, 14 aa, Artificial Sequence
  Description of Artificial Sequence: Synthetic Light chain variable region CDR L1 amino acid sequence
GSSTGAVTTSNYAN

SEQ ID NO: 1868 - DNA, 42 bp, Artificial Sequence; identical to SEQ ID NO: 204
  Description of Artificial Sequence: Synthetic Light chain variable region CDR L1 nucleic acid sequence

SEQ ID NO: 1869 - protein, 7 aa, Artificial Sequence
  Description of Artificial Sequence: Synthetic Light chain variable region CDR L2 amino acid sequence
GTDKRAP

SEQ ID NO: 1870 - DNA, 21 bp, Artificial Sequence
  Description of Artificial Sequence: Synthetic Light chain variable region CDR L2 nucleic acid sequence
ggcacagacaagcgcgctcct

SEQ ID NO: 1871 - protein, 9 aa, Artificial Sequence
  Description of Artificial Sequence: Synthetic Light chain variable region CDR L3 amino acid sequence
ALWYSNLWV

SEQ ID NO: 1872 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1873 - DNA, 375 bp, Artificial Sequence; identical to SEQ ID NO: 65
  Description of Artificial Sequence: Synthetic Heavy chain variable region nucleic acid sequence

SEQ ID NO: 1874 - protein, 125 aa, Artificial Sequence; identical to SEQ ID NO: 66
  Description of Artificial Sequence: Synthetic Heavy chain variable region amino acid sequence

SEQ ID NO: 1875 - protein, 9 aa, Artificial Sequence
  Description of Artificial Sequence: Synthetic Heavy chain variable region CDR H1 amino acid sequence
FTFDTYAMN

SEQ ID NO: 1876 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1877 - protein, 19 aa, Artificial Sequence
  Description of Artificial Sequence: Synthetic Heavy chain variable region CDR H2 amino acid sequence
RIRSKYNNYATYYADSVKG

SEQ ID NO: 1878 - DNA, 57 bp, Artificial Sequence; identical to SEQ ID NO: 70
  Description of Artificial Sequence: Synthetic Heavy chain variable region CDR H2 nucleic acid sequence

SEQ ID NO: 1879 - protein, 16 aa, Artificial Sequence
  Description of Artificial Sequence: Synthetic Heavy chain variable region CDR H3 amino acid sequence
VRHGNFGNSYVSWFAH

SEQ ID NO: 1880 - DNA, 48 bp, Artificial Sequence; identical to SEQ ID NO: 72
  Description of Artificial Sequence: Synthetic Heavy chain variable region CDR H3 nucleic acid sequence

SEQ ID NO: 1881 - DNA, 327 bp, Artificial Sequence; identical to SEQ ID NO: 1705
  Description of Artificial Sequence: Synthetic Light chain variable region nucleic acid sequence

SEQ ID NO: 1882 - protein, 109 aa, Artificial Sequence; identical to SEQ ID NO: 1706
  Description of Artificial Sequence: Synthetic Light chain variable region amino acid sequence

SEQ ID NO: 1883 - protein, 14 aa, Artificial Sequence
  Description of Artificial Sequence: Synthetic Light chain variable region CDR L1 amino acid sequence
GSSTGAVTTSNYAN

SEQ ID NO: 1884 - DNA, 42 bp, Artificial Sequence; identical to SEQ ID NO: 204
  Description of Artificial Sequence: Synthetic Light chain variable region CDR L1 nucleic acid sequence

SEQ ID NO: 1885 - protein, 7 aa, Artificial Sequence
  Description of Artificial Sequence: Synthetic Light chain variable region CDR L2 amino acid sequence
GTDKRAP

SEQ ID NO: 1886 - DNA, 21 bp, Artificial Sequence
  Description of Artificial Sequence: Synthetic Light chain variable region CDR L2 nucleic acid sequence
ggcacagacaagcgcgctcct

SEQ ID NO: 1887 - protein, 9 aa, Artificial Sequence
  Description of Artificial Sequence: Synthetic Light chain variable region CDR L3 amino acid sequence
VLWYSNLWV

SEQ ID NO: 1888 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 1889 - DNA, 375 bp, Artificial Sequence; identical to SEQ ID NO: 65
  Description of Artificial Sequence: Synthetic Heavy chain variable region nucleic acid sequence

SEQ ID NO: 1890 - protein, 125 aa, Artificial Sequence; identical to SEQ ID NO: 66
  Description of Artificial Sequence: Synthetic Heavy chain variable region amino acid sequence

SEQ ID NO: 1891 - protein, 9 aa, Artificial Sequence
  Description of Artificial Sequence: Synthetic Heavy chain variable region CDR H1 amino acid sequence
FTFDTYAMN

SEQ ID NO: 1892 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1893 - protein, 19 aa, Artificial Sequence
  Description of Artificial Sequence: Synthetic Heavy chain variable region CDR H2 amino acid sequence
RIRSKYNNYATYYADSVKG

SEQ ID NO: 1894 - DNA, 57 bp, Artificial Sequence; identical to SEQ ID NO: 70
  Description of Artificial Sequence: Synthetic Heavy chain variable region CDR H2 nucleic acid sequence

SEQ ID NO: 1895 - protein, 16 aa, Artificial Sequence
  Description of Artificial Sequence: Synthetic Heavy chain variable region CDR H3 amino acid sequence
VRHGNFGNSYVSWFAH

SEQ ID NO: 1896 - DNA, 48 bp, Artificial Sequence; identical to SEQ ID NO: 72
  Description of Artificial Sequence: Synthetic Heavy chain variable region CDR H3 nucleic acid sequence

SEQ ID NO: 1897 - DNA, 327 bp, Artificial Sequence; identical to SEQ ID NO: 201
  Description of Artificial Sequence: Synthetic Light chain variable region nucleic acid sequence

SEQ ID NO: 1898 - protein, 109 aa, Artificial Sequence; identical to SEQ ID NO: 202
  Description of Artificial Sequence: Synthetic Light chain variable region amino acid sequence

SEQ ID NO: 1899 - protein, 14 aa, Artificial Sequence
  Description of Artificial Sequence: Synthetic Light chain variable region CDR L1 amino acid sequence
GSSTGAVTTSNYAN

SEQ ID NO: 1900 - DNA, 42 bp, Artificial Sequence; identical to SEQ ID NO: 204
  Description of Artificial Sequence: Synthetic Light chain variable region CDR L1 nucleic acid sequence

SEQ ID NO: 1901 - protein, 7 aa, Artificial Sequence
  Description of Artificial Sequence: Synthetic Light chain variable region CDR L2 amino acid sequence
GTDKRAP

SEQ ID NO: 1902 - DNA, 21 bp, Artificial Sequence
  Description of Artificial Sequence: Synthetic Light chain variable region CDR L2 nucleic acid sequence
ggcacagacaagcgcgctcct

SEQ ID NO: 1903 - protein, 9 aa, Artificial Sequence
  Description of Artificial Sequence: Synthetic Light chain variable region CDR L3 amino acid sequence
ALWYSNHWV

SEQ ID NO: 1904 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1905 - DNA, 375 bp, Artificial Sequence; identical to SEQ ID NO: 65
  Description of Artificial Sequence: Synthetic Heavy chain variable region nucleic acid sequence

SEQ ID NO: 1906 - protein, 125 aa, Artificial Sequence; identical to SEQ ID NO: 66
  Description of Artificial Sequence: Synthetic Heavy chain variable region amino acid sequence

SEQ ID NO: 1907 - protein, 9 aa, Artificial Sequence
  Description of Artificial Sequence: Synthetic Heavy chain variable region CDR H1 amino acid sequence
FTFDTYAMN

SEQ ID NO: 1908 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1909 - protein, 19 aa, Artificial Sequence
  Description of Artificial Sequence: Synthetic Heavy chain variable region CDR H2 amino acid sequence
RIRSKYNNYATYYADSVKG

SEQ ID NO: 1910 - DNA, 57 bp, Artificial Sequence; identical to SEQ ID NO: 70
  Description of Artificial Sequence: Synthetic Heavy chain variable region CDR H2 nucleic acid sequence

SEQ ID NO: 1911 - protein, 16 aa, Artificial Sequence
  Description of Artificial Sequence: Synthetic Heavy chain variable region CDR H3 amino acid sequence
VRHGNFGNSYVSWFAH

SEQ ID NO: 1912 - DNA, 48 bp, Artificial Sequence; identical to SEQ ID NO: 72
  Description of Artificial Sequence: Synthetic Heavy chain variable region CDR H3 nucleic acid sequence

SEQ ID NO: 1913 - DNA, 327 bp, Artificial Sequence; identical to SEQ ID NO: 1721
  Description of Artificial Sequence: Synthetic Light chain variable region nucleic acid sequence

SEQ ID NO: 1914 - protein, 109 aa, Artificial Sequence; identical to SEQ ID NO: 1722
  Description of Artificial Sequence: Synthetic Light chain variable region amino acid sequence

SEQ ID NO: 1915 - protein, 14 aa, Artificial Sequence
  Description of Artificial Sequence: Synthetic Light chain variable region CDR L1 amino acid sequence
GSSTGAVTTSNYAN

SEQ ID NO: 1916 - DNA, 42 bp, Artificial Sequence; identical to SEQ ID NO: 204
  Description of Artificial Sequence: Synthetic Light chain variable region CDR L1 nucleic acid sequence

SEQ ID NO: 1917 - protein, 7 aa, Artificial Sequence
  Description of Artificial Sequence: Synthetic Light chain variable region CDR L2 amino acid sequence
GTDKRAP

SEQ ID NO: 1918 - DNA, 21 bp, Artificial Sequence
  Description of Artificial Sequence: Synthetic Light chain variable region CDR L2 nucleic acid sequence
ggcacagacaagcgcgctcct

SEQ ID NO: 1919 - protein, 9 aa, Artificial Sequence
  Description of Artificial Sequence: Synthetic Light chain variable region CDR L3 amino acid sequence
ALWYSNLWV

SEQ ID NO: 1920 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1921 - DNA, 375 bp, Artificial Sequence; identical to SEQ ID NO: 65
  Description of Artificial Sequence: Synthetic Heavy chain variable region nucleic acid sequence

SEQ ID NO: 1922 - protein, 125 aa, Artificial Sequence; identical to SEQ ID NO: 66
  Description of Artificial Sequence: Synthetic Heavy chain variable region amino acid sequence

SEQ ID NO: 1923 - protein, 9 aa, Artificial Sequence
  Description of Artificial Sequence: Synthetic Heavy chain variable region CDR H1 amino acid sequence
FTFDTYAMN

SEQ ID NO: 1924 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1925 - protein, 19 aa, Artificial Sequence
  Description of Artificial Sequence: Synthetic Heavy chain variable region CDR H2 amino acid sequence
RIRSKYNNYATYYADSVKG

SEQ ID NO: 1926 - DNA, 57 bp, Artificial Sequence; identical to SEQ ID NO: 70
  Description of Artificial Sequence: Synthetic Heavy chain variable region CDR H2 nucleic acid sequence

SEQ ID NO: 1927 - protein, 16 aa, Artificial Sequence
  Description of Artificial Sequence: Synthetic Heavy chain variable region CDR H3 amino acid sequence
VRHGNFGNSYVSWFAH

SEQ ID NO: 1928 - DNA, 48 bp, Artificial Sequence; identical to SEQ ID NO: 72
  Description of Artificial Sequence: Synthetic Heavy chain variable region CDR H3 nucleic acid sequence

SEQ ID NO: 1929 - DNA, 327 bp, Artificial Sequence; identical to SEQ ID NO: 1753
  Description of Artificial Sequence: Synthetic Light chain variable region nucleic acid sequence

SEQ ID NO: 1930 - protein, 109 aa, Artificial Sequence; identical to SEQ ID NO: 1754
  Description of Artificial Sequence: Synthetic Light chain variable region amino acid sequence

SEQ ID NO: 1931 - protein, 14 aa, Artificial Sequence
  Description of Artificial Sequence: Synthetic Light chain variable region CDR L1 amino acid sequence
GSSTGAVTTSNYAN

SEQ ID NO: 1932 - DNA, 42 bp, Artificial Sequence; identical to SEQ ID NO: 204
  Description of Artificial Sequence: Synthetic Light chain variable region CDR L1 nucleic acid sequence

SEQ ID NO: 1933 - protein, 7 aa, Artificial Sequence
  Description of Artificial Sequence: Synthetic Light chain variable region CDR L2 amino acid sequence
GTDKRAP

SEQ ID NO: 1934 - DNA, 21 bp, Artificial Sequence
  Description of Artificial Sequence: Synthetic Light chain variable region CDR L2 nucleic acid sequence
ggcacagacaagcgcgctcct

SEQ ID NO: 1935 - protein, 9 aa, Artificial Sequence
  Description of Artificial Sequence: Synthetic Light chain variable region CDR L3 amino acid sequence
ALWYSNLWV

SEQ ID NO: 1936 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 1937 - DNA, 375 bp, Artificial Sequence; identical to SEQ ID NO: 65
  Description of Artificial Sequence: Synthetic Heavy chain variable region nucleic acid sequence

SEQ ID NO: 1938 - protein, 125 aa, Artificial Sequence; identical to SEQ ID NO: 66
  Description of Artificial Sequence: Synthetic Heavy chain variable region amino acid sequence

SEQ ID NO: 1939 - protein, 9 aa, Artificial Sequence
  Description of Artificial Sequence: Synthetic Heavy chain variable region CDR H1 amino acid sequence
FTFDTYAMN

SEQ ID NO: 1940 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1941 - protein, 19 aa, Artificial Sequence
  Description of Artificial Sequence: Synthetic Heavy chain variable region CDR H2 amino acid sequence
RIRSKYNNYATYYADSVKG

SEQ ID NO: 1942 - DNA, 57 bp, Artificial Sequence; identical to SEQ ID NO: 70
  Description of Artificial Sequence: Synthetic Heavy chain variable region CDR H2 nucleic acid sequence

SEQ ID NO: 1943 - protein, 16 aa, Artificial Sequence
  Description of Artificial Sequence: Synthetic Heavy chain variable region CDR H3 amino acid sequence
VRHGNFGNSYVSWFAH

SEQ ID NO: 1944 - DNA, 48 bp, Artificial Sequence; identical to SEQ ID NO: 72
  Description of Artificial Sequence: Synthetic Heavy chain variable region CDR H3 nucleic acid sequence

SEQ ID NO: 1945 - DNA, 327 bp, Artificial Sequence; identical to SEQ ID NO: 1769
  Description of Artificial Sequence: Synthetic Light chain variable region nucleic acid sequence

SEQ ID NO: 1946 - protein, 109 aa, Artificial Sequence; identical to SEQ ID NO: 1770
  Description of Artificial Sequence: Synthetic Light chain variable region amino acid sequence

SEQ ID NO: 1947 - protein, 14 aa, Artificial Sequence
  Description of Artificial Sequence: Synthetic Light chain variable region CDR L1 amino acid sequence
GSSTGAVTTSNYAN

SEQ ID NO: 1948 - DNA, 42 bp, Artificial Sequence; identical to SEQ ID NO: 204
  Description of Artificial Sequence: Synthetic Light chain variable region CDR L1 nucleic acid sequence

SEQ ID NO: 1949 - protein, 7 aa, Artificial Sequence
  Description of Artificial Sequence: Synthetic Light chain variable region CDR L2 amino acid sequence
GTDKRAP

SEQ ID NO: 1950 - DNA, 21 bp, Artificial Sequence
  Description of Artificial Sequence: Synthetic Light chain variable region CDR L2 nucleic acid sequence
ggcacagacaagcgcgctcct

SEQ ID NO: 1951 - protein, 9 aa, Artificial Sequence
  Description of Artificial Sequence: Synthetic Light chain variable region CDR L3 amino acid sequence
ALWYNNLWV

SEQ ID NO: 1952 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 1953 - DNA, 375 bp, Artificial Sequence; identical to SEQ ID NO: 65
  Description of Artificial Sequence: Synthetic Heavy chain variable region nucleic acid sequence

SEQ ID NO: 1954 - protein, 125 aa, Artificial Sequence; identical to SEQ ID NO: 66
  Description of Artificial Sequence: Synthetic Heavy chain variable region amino acid sequence

SEQ ID NO: 1955 - protein, 9 aa, Artificial Sequence
  Description of Artificial Sequence: Synthetic Heavy chain variable region CDR H1 amino acid sequence
FTFDTYAMN

SEQ ID NO: 1956 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1957 - protein, 19 aa, Artificial Sequence
  Description of Artificial Sequence: Synthetic Heavy chain variable region CDR H2 amino acid sequence
RIRSKYNNYATYYADSVKG

SEQ ID NO: 1958 - DNA, 57 bp, Artificial Sequence; identical to SEQ ID NO: 70
  Description of Artificial Sequence: Synthetic Heavy chain variable region CDR H2 nucleic acid sequence

SEQ ID NO: 1959 - protein, 16 aa, Artificial Sequence
  Description of Artificial Sequence: Synthetic Heavy chain variable region CDR H3 amino acid sequence
VRHGNFGNSYVSWFAH

SEQ ID NO: 1960 - DNA, 48 bp, Artificial Sequence; identical to SEQ ID NO: 72
  Description of Artificial Sequence: Synthetic Heavy chain variable region CDR H3 nucleic acid sequence

SEQ ID NO: 1961 - DNA, 327 bp, Artificial Sequence; identical to SEQ ID NO: 1785
  Description of Artificial Sequence: Synthetic Light chain variable region nucleic acid sequence

SEQ ID NO: 1962 - protein, 109 aa, Artificial Sequence; identical to SEQ ID NO: 1786
  Description of Artificial Sequence: Synthetic Light chain variable region amino acid sequence

SEQ ID NO: 1963 - protein, 14 aa, Artificial Sequence
  Description of Artificial Sequence: Synthetic Light chain variable region CDR L1 amino acid sequence
GSSTGAVTTSNYAN

SEQ ID NO: 1964 - DNA, 42 bp, Artificial Sequence; identical to SEQ ID NO: 204
  Description of Artificial Sequence: Synthetic Light chain variable region CDR L1 nucleic acid sequence

SEQ ID NO: 1965 - protein, 7 aa, Artificial Sequence
  Description of Artificial Sequence: Synthetic Light chain variable region CDR L2 amino acid sequence
GTDKRAP

SEQ ID NO: 1966 - DNA, 21 bp, Artificial Sequence
  Description of Artificial Sequence: Synthetic Light chain variable region CDR L2 nucleic acid sequence
ggcacagacaagcgcgctcct

SEQ ID NO: 1967 - protein, 9 aa, Artificial Sequence
  Description of Artificial Sequence: Synthetic Light chain variable region CDR L3 amino acid sequence
VLWYSNLWV

SEQ ID NO: 1968 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 1969 - DNA, 375 bp, Artificial Sequence; identical to SEQ ID NO: 65
  Description of Artificial Sequence: Synthetic Heavy chain variable region nucleic acid sequence

SEQ ID NO: 1970 - protein, 125 aa, Artificial Sequence; identical to SEQ ID NO: 66
  Description of Artificial Sequence: Synthetic Heavy chain variable region amino acid sequence

SEQ ID NO: 1971 - protein, 9 aa, Artificial Sequence
  Description of Artificial Sequence: Synthetic Heavy chain variable region CDR H1 amino acid sequence
FTFDTYAMN

SEQ ID NO: 1972 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1973 - protein, 19 aa, Artificial Sequence
  Description of Artificial Sequence: Synthetic Heavy chain variable region CDR H2 amino acid sequence
RIRSKYNNYATYYADSVKG

SEQ ID NO: 1974 - DNA, 57 bp, Artificial Sequence; identical to SEQ ID NO: 70
  Description of Artificial Sequence: Synthetic Heavy chain variable region CDR H2 nucleic acid sequence

SEQ ID NO: 1975 - protein, 16 aa, Artificial Sequence
  Description of Artificial Sequence: Synthetic Heavy chain variable region CDR H3 amino acid sequence
VRHGNFGNSYVSWFAH

SEQ ID NO: 1976 - DNA, 48 bp, Artificial Sequence; identical to SEQ ID NO: 72
  Description of Artificial Sequence: Synthetic Heavy chain variable region CDR H3 nucleic acid sequence

SEQ ID NO: 1977 - DNA, 327 bp, Artificial Sequence; identical to SEQ ID NO: 217
  Description of Artificial Sequence: Synthetic Light chain variable region nucleic acid sequence

SEQ ID NO: 1978 - protein, 109 aa, Artificial Sequence; identical to SEQ ID NO: 218
  Description of Artificial Sequence: Synthetic Light chain variable region amino acid sequence

SEQ ID NO: 1979 - protein, 14 aa, Artificial Sequence
  Description of Artificial Sequence: Synthetic Light chain variable region CDR L1 amino acid sequence
GSSTGAVTTSNYAN

SEQ ID NO: 1980 - DNA, 42 bp, Artificial Sequence; identical to SEQ ID NO: 204
  Description of Artificial Sequence: Synthetic Light chain variable region CDR L1 nucleic acid sequence

SEQ ID NO: 1981 - protein, 7 aa, Artificial Sequence
  Description of Artificial Sequence: Synthetic Light chain variable region CDR L2 amino acid sequence
GTDKRAP

SEQ ID NO: 1982 - DNA, 21 bp, Artificial Sequence
  Description of Artificial Sequence: Synthetic Light chain variable region CDR L2 nucleic acid sequence
ggcacagacaagcgcgctcct

SEQ ID NO: 1983 - protein, 9 aa, Artificial Sequence
  Description of Artificial Sequence: Synthetic Light chain variable region CDR L3 amino acid sequence
ALWYSNHWV

SEQ ID NO: 1984 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 1985 - DNA, 375 bp, Artificial Sequence; identical to SEQ ID NO: 65
  Description of Artificial Sequence: Synthetic Heavy chain variable region nucleic acid sequence

SEQ ID NO: 1986 - protein, 125 aa, Artificial Sequence; identical to SEQ ID NO: 66
  Description of Artificial Sequence: Synthetic Heavy chain variable region amino acid sequence

SEQ ID NO: 1987 - protein, 9 aa, Artificial Sequence
  Description of Artificial Sequence: Synthetic Heavy chain variable region CDR H1 amino acid sequence
FTFDTYAMN

SEQ ID NO: 1988 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 1989 - protein, 19 aa, Artificial Sequence
  Description of Artificial Sequence: Synthetic Heavy chain variable region CDR H2 amino acid sequence
RIRSKYNNYATYYADSVKG

SEQ ID NO: 1990 - DNA, 57 bp, Artificial Sequence; identical to SEQ ID NO: 70
  Description of Artificial Sequence: Synthetic Heavy chain variable region CDR H2 nucleic acid sequence

SEQ ID NO: 1991 - protein, 16 aa, Artificial Sequence
  Description of Artificial Sequence: Synthetic Heavy chain variable region CDR H3 amino acid sequence
VRHGNFGNSYVSWFAH

SEQ ID NO: 1992 - DNA, 48 bp, Artificial Sequence; identical to SEQ ID NO: 72
  Description of Artificial Sequence: Synthetic Heavy chain variable region CDR H3 nucleic acid sequence

SEQ ID NO: 1993 - DNA, 327 bp, Artificial Sequence; identical to SEQ ID NO: 1801
  Description of Artificial Sequence: Synthetic Light chain variable region nucleic acid sequence

SEQ ID NO: 1994 - protein, 109 aa, Artificial Sequence; identical to SEQ ID NO: 1802
  Description of Artificial Sequence: Synthetic Light chain variable region amino acid sequence

SEQ ID NO: 1995 - protein, 14 aa, Artificial Sequence
  Description of Artificial Sequence: Synthetic Light chain variable region CDR L1 amino acid sequence
GSSAGAVTTSNYAN

SEQ ID NO: 1996 - DNA, 42 bp, Artificial Sequence; identical to SEQ ID NO: 236
  Description of Artificial Sequence: Synthetic Light chain variable region CDR L1 nucleic acid sequence

SEQ ID NO: 1997 - protein, 7 aa, Artificial Sequence
  Description of Artificial Sequence: Synthetic Light chain variable region CDR L2 amino acid sequence
GTDKRAP

SEQ ID NO: 1998 - DNA, 21 bp, Artificial Sequence
  Description of Artificial Sequence: Synthetic Light chain variable region CDR L2 nucleic acid sequence
ggcacagacaagcgcgctcct

SEQ ID NO: 1999 - protein, 9 aa, Artificial Sequence
  Description of Artificial Sequence: Synthetic Light chain variable region CDR L3 amino acid sequence
ALWYSNLWV

SEQ ID NO: 2000 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2001 - DNA, 375 bp, Artificial Sequence; identical to SEQ ID NO: 65
  Description of Artificial Sequence: Synthetic Heavy chain variable region nucleic acid sequence

SEQ ID NO: 2002 - protein, 125 aa, Artificial Sequence; identical to SEQ ID NO: 66
  Description of Artificial Sequence: Synthetic Heavy chain variable region amino acid sequence

SEQ ID NO: 2003 - protein, 9 aa, Artificial Sequence
  Description of Artificial Sequence: Synthetic Heavy chain variable region CDR H1 amino acid sequence
FTFDTYAMN

SEQ ID NO: 2004 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2005 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2006 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2007 - protein, 16 aa, Artificial Sequence
  Description of Artificial Sequence: Synthetic Heavy chain variable region CDR H3 amino acid sequence
VRHGNFGNSYVSWFAH

SEQ ID NO: 2008 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2009 - DNA, 327 bp, Artificial Sequence; identical to SEQ ID NO: 233
  Description of Artificial Sequence: Synthetic Light chain variable region nucleic acid sequence

SEQ ID NO: 2010 - protein, 109 aa, Artificial Sequence; identical to SEQ ID NO: 234
  Description of Artificial Sequence: Synthetic Light chain variable region amino acid sequence

SEQ ID NO: 2011 - protein, 14 aa, Artificial Sequence
  Description of Artificial Sequence: Synthetic Light chain variable region CDR L1 amino acid sequence
GSSAGAVTTSNYAN

SEQ ID NO: 2012 - DNA, 42 bp, Artificial Sequence; identical to SEQ ID NO: 236
  Description of Artificial Sequence: Synthetic Light chain variable region CDR L1 nucleic acid sequence

SEQ ID NO: 2013 - protein, 7 aa, Artificial Sequence
  Description of Artificial Sequence: Synthetic Light chain variable region CDR L2 amino acid sequence
GTDKRAP

SEQ ID NO: 2014 - DNA, 21 bp, Artificial Sequence
  Description of Artificial Sequence: Synthetic Light chain variable region CDR L2 nucleic acid sequence
ggcacagacaagcgcgctcct

SEQ ID NO: 2015 - protein, 9 aa, Artificial Sequence
  Description of Artificial Sequence: Synthetic Light chain variable region CDR L3 amino acid sequence
VLWYSNLWV

SEQ ID NO: 2016 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 2017 - DNA, 375 bp, Artificial Sequence; identical to SEQ ID NO: 65
  Description of Artificial Sequence: Synthetic Heavy chain variable region nucleic acid sequence

SEQ ID NO: 2018 - protein, 125 aa, Artificial Sequence; identical to SEQ ID NO: 66
  Description of Artificial Sequence: Synthetic Heavy chain variable region amino acid sequence

SEQ ID NO: 2019 - protein, 9 aa, Artificial Sequence
  Description of Artificial Sequence: Synthetic Heavy chain variable region CDR H1 amino acid sequence
FTFDTYAMN

SEQ ID NO: 2020 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2021 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2022 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2023 - protein, 16 aa, Artificial Sequence
  Description of Artificial Sequence: Synthetic Heavy chain variable region CDR H3 amino acid sequence
VRHGNFGNSYVSWFAH

SEQ ID NO: 2024 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2025 - DNA, 327 bp, Artificial Sequence; identical to SEQ ID NO: 249
  Description of Artificial Sequence: Synthetic Light chain variable region nucleic acid sequence

SEQ ID NO: 2026 - protein, 109 aa, Artificial Sequence; identical to SEQ ID NO: 250
  Description of Artificial Sequence: Synthetic Light chain variable region amino acid sequence

SEQ ID NO: 2027 - protein, 14 aa, Artificial Sequence
  Description of Artificial Sequence: Synthetic Light chain variable region CDR L1 amino acid sequence
GSSAGAVTTSNYAN

SEQ ID NO: 2028 - DNA, 42 bp, Artificial Sequence; identical to SEQ ID NO: 236
  Description of Artificial Sequence: Synthetic Light chain variable region CDR L1 nucleic acid sequence

SEQ ID NO: 2029 - protein, 7 aa, Artificial Sequence
  Description of Artificial Sequence: Synthetic Light chain variable region CDR L2 amino acid sequence
GTDKRAP

SEQ ID NO: 2030 - DNA, 21 bp, Artificial Sequence
  Description of Artificial Sequence: Synthetic Light chain variable region CDR L2 nucleic acid sequence
ggcacagacaagcgcgctcct

SEQ ID NO: 2031 - protein, 9 aa, Artificial Sequence
  Description of Artificial Sequence: Synthetic Light chain variable region CDR L3 amino acid sequence
ALWYSNHWV

SEQ ID NO: 2032 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 2033 - DNA, 375 bp, Artificial Sequence; identical to SEQ ID NO: 65
  Description of Artificial Sequence: Synthetic Heavy chain variable region nucleic acid sequence

SEQ ID NO: 2034 - protein, 125 aa, Artificial Sequence; identical to SEQ ID NO: 66
  Description of Artificial Sequence: Synthetic Heavy chain variable region amino acid sequence

SEQ ID NO: 2035 - protein, 9 aa, Artificial Sequence
  Description of Artificial Sequence: Synthetic Heavy chain variable region CDR H1 amino acid sequence
FTFDTYAMN

SEQ ID NO: 2036 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2037 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2038 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2039 - protein, 16 aa, Artificial Sequence
  Description of Artificial Sequence: Synthetic Heavy chain variable region CDR H3 amino acid sequence
VRHGNFGNSYVSWFAH

SEQ ID NO: 2040 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2041 - DNA, 327 bp, Artificial Sequence; identical to SEQ ID NO: 1817
  Description of Artificial Sequence: Synthetic Light chain variable region nucleic acid sequence

SEQ ID NO: 2042 - protein, 109 aa, Artificial Sequence; identical to SEQ ID NO: 1818
  Description of Artificial Sequence: Synthetic Light chain variable region amino acid sequence

SEQ ID NO: 2043 - protein, 14 aa, Artificial Sequence
  Description of Artificial Sequence: Synthetic Light chain variable region CDR L1 amino acid sequence
GSSTGAVTTSNYAN

SEQ ID NO: 2044 - DNA, 42 bp, Artificial Sequence; identical to SEQ ID NO: 204
  Description of Artificial Sequence: Synthetic Light chain variable region CDR L1 nucleic acid sequence

SEQ ID NO: 2045 - protein, 7 aa, Artificial Sequence
  Description of Artificial Sequence: Synthetic Light chain variable region CDR L2 amino acid sequence
GTDKRAP

SEQ ID NO: 2046 - DNA, 21 bp, Artificial Sequence
  Description of Artificial Sequence: Synthetic Light chain variable region CDR L2 nucleic acid sequence
ggcacagacaagcgcgctcct

SEQ ID NO: 2047 - protein, 9 aa, Artificial Sequence
  Description of Artificial Sequence: Synthetic Light chain variable region CDR L3 amino acid sequence
ALWYNNLWV

SEQ ID NO: 2048 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 2049 - DNA, 375 bp, Artificial Sequence; identical to SEQ ID NO: 65
  Description of Artificial Sequence: Synthetic Heavy chain variable region nucleic acid sequence

SEQ ID NO: 2050 - protein, 125 aa, Artificial Sequence; identical to SEQ ID NO: 66
  Description of Artificial Sequence: Synthetic Heavy chain variable region amino acid sequence

SEQ ID NO: 2051 - protein, 9 aa, Artificial Sequence
  Description of Artificial Sequence: Synthetic Heavy chain variable region CDR H1 amino acid sequence
FTFDTYAMN

SEQ ID NO: 2052 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2053 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2054 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2055 - protein, 16 aa, Artificial Sequence
  Description of Artificial Sequence: Synthetic Heavy chain variable region CDR H3 amino acid sequence
VRHGNFGNSYVSWFAH

SEQ ID NO: 2056 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2057 - DNA, 327 bp, Artificial Sequence; identical to SEQ ID NO: 1833
  Description of Artificial Sequence: Synthetic Light chain variable region nucleic acid sequence

SEQ ID NO: 2058 - protein, 109 aa, Artificial Sequence; identical to SEQ ID NO: 1834
  Description of Artificial Sequence: Synthetic Light chain variable region amino acid sequence

SEQ ID NO: 2059 - protein, 14 aa, Artificial Sequence
  Description of Artificial Sequence: Synthetic Light chain variable region CDR L1 amino acid sequence
GSSTGAVTTSNYAN

SEQ ID NO: 2060 - DNA, 42 bp, Artificial Sequence; identical to SEQ ID NO: 204
  Description of Artificial Sequence: Synthetic Light chain variable region CDR L1 nucleic acid sequence

SEQ ID NO: 2061 - protein, 7 aa, Artificial Sequence
  Description of Artificial Sequence: Synthetic Light chain variable region CDR L2 amino acid sequence
GTDKRAP

SEQ ID NO: 2062 - DNA, 21 bp, Artificial Sequence
  Description of Artificial Sequence: Synthetic Light chain variable region CDR L2 nucleic acid sequence
ggcacagacaagcgcgctcct

SEQ ID NO: 2063 - protein, 9 aa, Artificial Sequence
  Description of Artificial Sequence: Synthetic Light chain variable region CDR L3 amino acid sequence
VLWYSNLWV

SEQ ID NO: 2064 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 2065 - DNA, 375 bp, Artificial Sequence; identical to SEQ ID NO: 145
  Description of Artificial Sequence: Synthetic Heavy chain variable region nucleic acid sequence

SEQ ID NO: 2066 - protein, 125 aa, Artificial Sequence; identical to SEQ ID NO: 146
  Description of Artificial Sequence: Synthetic Heavy chain variable region amino acid sequence

SEQ ID NO: 2067 - protein, 9 aa, Artificial Sequence
  Description of Artificial Sequence: Synthetic Heavy chain variable region CDR H1 amino acid sequence
FTFDTYAMN

SEQ ID NO: 2068 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2069 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2070 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2071 - protein, 16 aa, Artificial Sequence
  Description of Artificial Sequence: Synthetic Heavy chain variable region CDR H3 amino acid sequence
VRHSNFGNSYVSWFAH

SEQ ID NO: 2072 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2073 - DNA, 327 bp, Artificial Sequence; identical to SEQ ID NO: 1673
  Description of Artificial Sequence: Synthetic Light chain variable region nucleic acid sequence

SEQ ID NO: 2074 - protein, 109 aa, Artificial Sequence; identical to SEQ ID NO: 1674
  Description of Artificial Sequence: Synthetic Light chain variable region amino acid sequence

SEQ ID NO: 2075 - protein, 14 aa, Artificial Sequence
  Description of Artificial Sequence: Synthetic Light chain variable region CDR L1 amino acid sequence
GSSTGAVTTSNYAN

SEQ ID NO: 2076 - DNA, 42 bp, Artificial Sequence; identical to SEQ ID NO: 204
  Description of Artificial Sequence: Synthetic Light chain variable region CDR L1 nucleic acid sequence

SEQ ID NO: 2077 - protein, 7 aa, Artificial Sequence
  Description of Artificial Sequence: Synthetic Light chain variable region CDR L2 amino acid sequence
GTDKRAP

SEQ ID NO: 2078 - DNA, 21 bp, Artificial Sequence
  Description of Artificial Sequence: Synthetic Light chain variable region CDR L2 nucleic acid sequence
ggcacagacaagcgcgctcct

SEQ ID NO: 2079 - protein, 9 aa, Artificial Sequence
  Description of Artificial Sequence: Synthetic Light chain variable region CDR L3 amino acid sequence
ALWYSNLWV

SEQ ID NO: 2080 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2081 - DNA, 375 bp, Artificial Sequence; identical to SEQ ID NO: 145
  Description of Artificial Sequence: Synthetic Heavy chain variable region nucleic acid sequence

SEQ ID NO: 2082 - protein, 125 aa, Artificial Sequence; identical to SEQ ID NO: 146
  Description of Artificial Sequence: Synthetic Heavy chain variable region amino acid sequence

SEQ ID NO: 2083 - protein, 9 aa, Artificial Sequence
  Description of Artificial Sequence: Synthetic Heavy chain variable region CDR H1 amino acid sequence
FTFDTYAMN

SEQ ID NO: 2084 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2085 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2086 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2087 - protein, 16 aa, Artificial Sequence
  Description of Artificial Sequence: Synthetic Heavy chain variable region CDR H3 amino acid sequence
VRHSNFGNSYVSWFAH

SEQ ID NO: 2088 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2089 - DNA, 327 bp, Artificial Sequence; identical to SEQ ID NO: 1689
  Description of Artificial Sequence: Synthetic Light chain variable region nucleic acid sequence

SEQ ID NO: 2090 - protein, 109 aa, Artificial Sequence; identical to SEQ ID NO: 1690
  Description of Artificial Sequence: Synthetic Light chain variable region amino acid sequence

SEQ ID NO: 2091 - protein, 14 aa, Artificial Sequence
  Description of Artificial Sequence: Synthetic Light chain variable region CDR L1 amino acid sequence
GSSTGAVTTSNYAN

SEQ ID NO: 2092 - DNA, 42 bp, Artificial Sequence; identical to SEQ ID NO: 204
  Description of Artificial Sequence: Synthetic Light chain variable region CDR L1 nucleic acid sequence

SEQ ID NO: 2093 - protein, 7 aa, Artificial Sequence
  Description of Artificial Sequence: Synthetic Light chain variable region CDR L2 amino acid sequence
GTDKRAP

SEQ ID NO: 2094 - DNA, 21 bp, Artificial Sequence
  Description of Artificial Sequence: Synthetic Light chain variable region CDR L2 nucleic acid sequence
ggcacagacaagcgcgctcct

SEQ ID NO: 2095 - protein, 9 aa, Artificial Sequence
  Description of Artificial Sequence: Synthetic Light chain variable region CDR L3 amino acid sequence
ALWYSNLWV

SEQ ID NO: 2096 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2097 - DNA, 375 bp, Artificial Sequence; identical to SEQ ID NO: 145
  Description of Artificial Sequence: Synthetic Heavy chain variable region nucleic acid sequence

SEQ ID NO: 2098 - protein, 125 aa, Artificial Sequence; identical to SEQ ID NO: 146
  Description of Artificial Sequence: Synthetic Heavy chain variable region amino acid sequence

SEQ ID NO: 2099 - protein, 9 aa, Artificial Sequence
  Description of Artificial Sequence: Synthetic Heavy chain variable region CDR H1 amino acid sequence
FTFDTYAMN

SEQ ID NO: 2100 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2101 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2102 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2103 - protein, 16 aa, Artificial Sequence
  Description of Artificial Sequence: Synthetic Heavy chain variable region CDR H3 amino acid sequence
VRHSNFGNSYVSWFAH

SEQ ID NO: 2104 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2105 - DNA, 327 bp, Artificial Sequence; identical to SEQ ID NO: 1705
  Description of Artificial Sequence: Synthetic Light chain variable region nucleic acid sequence

SEQ ID NO: 2106 - protein, 109 aa, Artificial Sequence; identical to SEQ ID NO: 1706
  Description of Artificial Sequence: Synthetic Light chain variable region amino acid sequence

SEQ ID NO: 2107 - protein, 14 aa, Artificial Sequence
  Description of Artificial Sequence: Synthetic Light chain variable region CDR L1 amino acid sequence
GSSTGAVTTSNYAN

SEQ ID NO: 2108 - DNA, 42 bp, Artificial Sequence; identical to SEQ ID NO: 204
  Description of Artificial Sequence: Synthetic Light chain variable region CDR L1 nucleic acid sequence

SEQ ID NO: 2109 - protein, 7 aa, Artificial Sequence
  Description of Artificial Sequence: Synthetic Light chain variable region CDR L2 amino acid sequence
GTDKRAP

SEQ ID NO: 2110 - DNA, 21 bp, Artificial Sequence
  Description of Artificial Sequence: Synthetic Light chain variable region CDR L2 nucleic acid sequence
ggcacagacaagcgcgctcct

SEQ ID NO: 2111 - protein, 9 aa, Artificial Sequence
  Description of Artificial Sequence: Synthetic Light chain variable region CDR L3 amino acid sequence
VLWYSNLWV

SEQ ID NO: 2112 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 2113 - DNA, 375 bp, Artificial Sequence; identical to SEQ ID NO: 145
  Description of Artificial Sequence: Synthetic Heavy chain variable region nucleic acid sequence

SEQ ID NO: 2114 - protein, 125 aa, Artificial Sequence; identical to SEQ ID NO: 146
  Description of Artificial Sequence: Synthetic Heavy chain variable region amino acid sequence

SEQ ID NO: 2115 - protein, 9 aa, Artificial Sequence
  Description of Artificial Sequence: Synthetic Heavy chain variable region CDR H1 amino acid sequence
FTFDTYAMN

SEQ ID NO: 2116 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2117 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2118 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2119 - protein, 16 aa, Artificial Sequence
  Description of Artificial Sequence: Synthetic Heavy chain variable region CDR H3 amino acid sequence
VRHSNFGNSYVSWFAH

SEQ ID NO: 2120 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2121 - DNA, 327 bp, Artificial Sequence; identical to SEQ ID NO: 201
  Description of Artificial Sequence: Synthetic Light chain variable region nucleic acid sequence

SEQ ID NO: 2122 - protein, 109 aa, Artificial Sequence; identical to SEQ ID NO: 202
  Description of Artificial Sequence: Synthetic Light chain variable region amino acid sequence

SEQ ID NO: 2123 - protein, 14 aa, Artificial Sequence
  Description of Artificial Sequence: Synthetic Light chain variable region CDR L1 amino acid sequence
GSSTGAVTTSNYAN

SEQ ID NO: 2124 - DNA, 42 bp, Artificial Sequence; identical to SEQ ID NO: 204
  Description of Artificial Sequence: Synthetic Light chain variable region CDR L1 nucleic acid sequence

SEQ ID NO: 2125 - protein, 7 aa, Artificial Sequence
  Description of Artificial Sequence: Synthetic Light chain variable region CDR L2 amino acid sequence
GTDKRAP

SEQ ID NO: 2126 - DNA, 21 bp, Artificial Sequence
  Description of Artificial Sequence: Synthetic Light chain variable region CDR L2 nucleic acid sequence
ggcacagacaagcgcgctcct

SEQ ID NO: 2127 - protein, 9 aa, Artificial Sequence
  Description of Artificial Sequence: Synthetic Light chain variable region CDR L3 amino acid sequence
ALWYSNHWV

SEQ ID NO: 2128 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 2129 - DNA, 375 bp, Artificial Sequence; identical to SEQ ID NO: 145
  Description of Artificial Sequence: Synthetic Heavy chain variable region nucleic acid sequence

SEQ ID NO: 2130 - protein, 125 aa, Artificial Sequence; identical to SEQ ID NO: 146
  Description of Artificial Sequence: Synthetic Heavy chain variable region amino acid sequence

SEQ ID NO: 2131 - protein, 9 aa, Artificial Sequence
  Description of Artificial Sequence: Synthetic Heavy chain variable region CDR H1 amino acid sequence
FTFDTYAMN

SEQ ID NO: 2132 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2133 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2134 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2135 - protein, 16 aa, Artificial Sequence
  Description of Artificial Sequence: Synthetic Heavy chain variable region CDR H3 amino acid sequence
VRHSNFGNSYVSWFAH

SEQ ID NO: 2136 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2137 - DNA, 327 bp, Artificial Sequence; identical to SEQ ID NO: 1721
  Description of Artificial Sequence: Synthetic Light chain variable region nucleic acid sequence

SEQ ID NO: 2138 - protein, 109 aa, Artificial Sequence; identical to SEQ ID NO: 1722
  Description of Artificial Sequence: Synthetic Light chain variable region amino acid sequence

SEQ ID NO: 2139 - protein, 14 aa, Artificial Sequence
  Description of Artificial Sequence: Synthetic Light chain variable region CDR L1 amino acid sequence
GSSTGAVTTSNYAN

SEQ ID NO: 2140 - DNA, 42 bp, Artificial Sequence; identical to SEQ ID NO: 204
  Description of Artificial Sequence: Synthetic Light chain variable region CDR L1 nucleic acid sequence

SEQ ID NO: 2141 - protein, 7 aa, Artificial Sequence
  Description of Artificial Sequence: Synthetic Light chain variable region CDR L2 amino acid sequence
GTDKRAP

SEQ ID NO: 2142 - DNA, 21 bp, Artificial Sequence
  Description of Artificial Sequence: Synthetic Light chain variable region CDR L2 nucleic acid sequence
ggcacagacaagcgcgctcct

SEQ ID NO: 2143 - protein, 9 aa, Artificial Sequence
  Description of Artificial Sequence: Synthetic Light chain variable region CDR L3 amino acid sequence
ALWYSNLWV

SEQ ID NO: 2144 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2145 - DNA, 375 bp, Artificial Sequence; identical to SEQ ID NO: 145
  Description of Artificial Sequence: Synthetic Heavy chain variable region nucleic acid sequence

SEQ ID NO: 2146 - protein, 125 aa, Artificial Sequence; identical to SEQ ID NO: 146
  Description of Artificial Sequence: Synthetic Heavy chain variable region amino acid sequence

SEQ ID NO: 2147 - protein, 9 aa, Artificial Sequence
  Description of Artificial Sequence: Synthetic Heavy chain variable region CDR H1 amino acid sequence
FTFDTYAMN

SEQ ID NO: 2148 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2149 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2150 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2151 - protein, 16 aa, Artificial Sequence
  Description of Artificial Sequence: Synthetic Heavy chain variable region CDR H3 amino acid sequence
VRHSNFGNSYVSWFAH

SEQ ID NO: 2152 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2153 - DNA, 327 bp, Artificial Sequence; identical to SEQ ID NO: 1737
  Description of Artificial Sequence: Synthetic Light chain variable region nucleic acid sequence

SEQ ID NO: 2154 - protein, 109 aa, Artificial Sequence; identical to SEQ ID NO: 1738
  Description of Artificial Sequence: Synthetic Light chain variable region amino acid sequence

SEQ ID NO: 2155 - protein, 14 aa, Artificial Sequence
  Description of Artificial Sequence: Synthetic Light chain variable region CDR L1 amino acid sequence
GSSAGAVTTSNYAN

SEQ ID NO: 2156 - DNA, 42 bp, Artificial Sequence; identical to SEQ ID NO: 236
  Description of Artificial Sequence: Synthetic Light chain variable region CDR L1 nucleic acid sequence

SEQ ID NO: 2157 - protein, 7 aa, Artificial Sequence
  Description of Artificial Sequence: Synthetic Light chain variable region CDR L2 amino acid sequence
GTDKRAP

SEQ ID NO: 2158 - DNA, 21 bp, Artificial Sequence
  Description of Artificial Sequence: Synthetic Light chain variable region CDR L2 nucleic acid sequence
ggcacagacaagcgcgctcct

SEQ ID NO: 2159 - protein, 9 aa, Artificial Sequence
  Description of Artificial Sequence: Synthetic Light chain variable region CDR L3 amino acid sequence
ALWYSNLWV

SEQ ID NO: 2160 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2161 - DNA, 375 bp, Artificial Sequence; identical to SEQ ID NO: 145
  Description of Artificial Sequence: Synthetic Heavy chain variable region nucleic acid sequence

SEQ ID NO: 2162 - protein, 125 aa, Artificial Sequence; identical to SEQ ID NO: 146
  Description of Artificial Sequence: Synthetic Heavy chain variable region amino acid sequence

SEQ ID NO: 2163 - protein, 9 aa, Artificial Sequence
  Description of Artificial Sequence: Synthetic Heavy chain variable region CDR H1 amino acid sequence
FTFDTYAMN

SEQ ID NO: 2164 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2165 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2166 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2167 - protein, 16 aa, Artificial Sequence
  Description of Artificial Sequence: Synthetic Heavy chain variable region CDR H3 amino acid sequence
VRHSNFGNSYVSWFAH

SEQ ID NO: 2168 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2169 - DNA, 327 bp, Artificial Sequence; identical to SEQ ID NO: 1753
  Description of Artificial Sequence: Synthetic Light chain variable region nucleic acid sequence

SEQ ID NO: 2170 - protein, 109 aa, Artificial Sequence; identical to SEQ ID NO: 1754
  Description of Artificial Sequence: Synthetic Light chain variable region amino acid sequence

SEQ ID NO: 2171 - protein, 14 aa, Artificial Sequence
  Description of Artificial Sequence: Synthetic Light chain variable region CDR L1 amino acid sequence
GSSTGAVTTSNYAN

SEQ ID NO: 2172 - DNA, 42 bp, Artificial Sequence; identical to SEQ ID NO: 204
  Description of Artificial Sequence: Synthetic Light chain variable region CDR L1 nucleic acid sequence

SEQ ID NO: 2173 - protein, 7 aa, Artificial Sequence
  Description of Artificial Sequence: Synthetic Light chain variable region CDR L2 amino acid sequence
GTDKRAP

SEQ ID NO: 2174 - DNA, 21 bp, Artificial Sequence
  Description of Artificial Sequence: Synthetic Light chain variable region CDR L2 nucleic acid sequence
ggcacagacaagcgcgctcct

SEQ ID NO: 2175 - protein, 9 aa, Artificial Sequence
  Description of Artificial Sequence: Synthetic Light chain variable region CDR L3 amino acid sequence
ALWYSNLWV

SEQ ID NO: 2176 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2177 - DNA, 375 bp, Artificial Sequence; identical to SEQ ID NO: 145
  Description of Artificial Sequence: Synthetic Heavy chain variable region nucleic acid sequence

SEQ ID NO: 2178 - protein, 125 aa, Artificial Sequence; identical to SEQ ID NO: 146
  Description of Artificial Sequence: Synthetic Heavy chain variable region amino acid sequence

SEQ ID NO: 2179 - protein, 9 aa, Artificial Sequence
  Description of Artificial Sequence: Synthetic Heavy chain variable region CDR H1 amino acid sequence
FTFDTYAMN

SEQ ID NO: 2180 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2181 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2182 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2183 - protein, 16 aa, Artificial Sequence
  Description of Artificial Sequence: Synthetic Heavy chain variable region CDR H3 amino acid sequence
VRHSNFGNSYVSWFAH

SEQ ID NO: 2184 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2185 - DNA, 327 bp, Artificial Sequence; identical to SEQ ID NO: 1769
  Description of Artificial Sequence: Synthetic Light chain variable region nucleic acid sequence

SEQ ID NO: 2186 - protein, 109 aa, Artificial Sequence; identical to SEQ ID NO: 1770
  Description of Artificial Sequence: Synthetic Light chain variable region amino acid sequence

SEQ ID NO: 2187 - protein, 14 aa, Artificial Sequence
  Description of Artificial Sequence: Synthetic Light chain variable region CDR L1 amino acid sequence
GSSTGAVTTSNYAN

SEQ ID NO: 2188 - DNA, 42 bp, Artificial Sequence; identical to SEQ ID NO: 204
  Description of Artificial Sequence: Synthetic Light chain variable region CDR L1 nucleic acid sequence

SEQ ID NO: 2189 - protein, 7 aa, Artificial Sequence
  Description of Artificial Sequence: Synthetic Light chain variable region CDR L2 amino acid sequence
GTDKRAP

SEQ ID NO: 2190 - DNA, 21 bp, Artificial Sequence
  Description of Artificial Sequence: Synthetic Light chain variable region CDR L2 nucleic acid sequence
ggcacagacaagcgcgctcct

SEQ ID NO: 2191 - protein, 9 aa, Artificial Sequence
  Description of Artificial Sequence: Synthetic Light chain variable region CDR L3 amino acid sequence
ALWYNNLWV

SEQ ID NO: 2192 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 2193 - DNA, 375 bp, Artificial Sequence; identical to SEQ ID NO: 145
  Description of Artificial Sequence: Synthetic Heavy chain variable region nucleic acid sequence

SEQ ID NO: 2194 - protein, 125 aa, Artificial Sequence; identical to SEQ ID NO: 146
  Description of Artificial Sequence: Synthetic Heavy chain variable region amino acid sequence

SEQ ID NO: 2195 - protein, 9 aa, Artificial Sequence
  Description of Artificial Sequence: Synthetic Heavy chain variable region CDR H1 amino acid sequence
FTFDTYAMN

SEQ ID NO: 2196 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2197 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2198 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2199 - protein, 16 aa, Artificial Sequence
  Description of Artificial Sequence: Synthetic Heavy chain variable region CDR H3 amino acid sequence
VRHSNFGNSYVSWFAH

SEQ ID NO: 2200 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2201 - DNA, 327 bp, Artificial Sequence; identical to SEQ ID NO: 1785
  Description of Artificial Sequence: Synthetic Light chain variable region nucleic acid sequence

SEQ ID NO: 2202 - protein, 109 aa, Artificial Sequence; identical to SEQ ID NO: 1786
  Description of Artificial Sequence: Synthetic Light chain variable region amino acid sequence

SEQ ID NO: 2203 - protein, 14 aa, Artificial Sequence
  Description of Artificial Sequence: Synthetic Light chain variable region CDR L1 amino acid sequence
GSSTGAVTTSNYAN

SEQ ID NO: 2204 - DNA, 42 bp, Artificial Sequence; identical to SEQ ID NO: 204
  Description of Artificial Sequence: Synthetic Light chain variable region CDR L1 nucleic acid sequence

SEQ ID NO: 2205 - protein, 7 aa, Artificial Sequence
  Description of Artificial Sequence: Synthetic Light chain variable region CDR L2 amino acid sequence
GTDKRAP

SEQ ID NO: 2206 - DNA, 21 bp, Artificial Sequence
  Description of Artificial Sequence: Synthetic Light chain variable region CDR L2 nucleic acid sequence
ggcacagacaagcgcgctcct

SEQ ID NO: 2207 - protein, 9 aa, Artificial Sequence
  Description of Artificial Sequence: Synthetic Light chain variable region CDR L3 amino acid sequence
VLWYSNLWV

SEQ ID NO: 2208 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 2209 - DNA, 375 bp, Artificial Sequence; identical to SEQ ID NO: 145
  Description of Artificial Sequence: Synthetic Heavy chain variable region nucleic acid sequence

SEQ ID NO: 2210 - protein, 125 aa, Artificial Sequence; identical to SEQ ID NO: 146
  Description of Artificial Sequence: Synthetic Heavy chain variable region amino acid sequence

SEQ ID NO: 2211 - protein, 9 aa, Artificial Sequence
  Description of Artificial Sequence: Synthetic Heavy chain variable region CDR H1 amino acid sequence
FTFDTYAMN

SEQ ID NO: 2212 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2213 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2214 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2215 - protein, 16 aa, Artificial Sequence
  Description of Artificial Sequence: Synthetic Heavy chain variable region CDR H3 amino acid sequence
VRHSNFGNSYVSWFAH

SEQ ID NO: 2216 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2217 - DNA, 327 bp, Artificial Sequence; identical to SEQ ID NO: 217
  Description of Artificial Sequence: Synthetic Light chain variable region nucleic acid sequence

SEQ ID NO: 2218 - protein, 109 aa, Artificial Sequence; identical to SEQ ID NO: 218
  Description of Artificial Sequence: Synthetic Light chain variable region amino acid sequence

SEQ ID NO: 2219 - protein, 14 aa, Artificial Sequence
  Description of Artificial Sequence: Synthetic Light chain variable region CDR L1 amino acid sequence
GSSTGAVTTSNYAN

SEQ ID NO: 2220 - DNA, 42 bp, Artificial Sequence; identical to SEQ ID NO: 204
  Description of Artificial Sequence: Synthetic Light chain variable region CDR L1 nucleic acid sequence

SEQ ID NO: 2221 - protein, 7 aa, Artificial Sequence
  Description of Artificial Sequence: Synthetic Light chain variable region CDR L2 amino acid sequence
GTDKRAP

SEQ ID NO: 2222 - DNA, 21 bp, Artificial Sequence
  Description of Artificial Sequence: Synthetic Light chain variable region CDR L2 nucleic acid sequence
ggcacagacaagcgcgctcct

SEQ ID NO: 2223 - protein, 9 aa, Artificial Sequence
  Description of Artificial Sequence: Synthetic Light chain variable region CDR L3 amino acid sequence
ALWYSNHWV

SEQ ID NO: 2224 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 2225 - DNA, 375 bp, Artificial Sequence; identical to SEQ ID NO: 145
  Description of Artificial Sequence: Synthetic Heavy chain variable region nucleic acid sequence

SEQ ID NO: 2226 - protein, 125 aa, Artificial Sequence; identical to SEQ ID NO: 146
  Description of Artificial Sequence: Synthetic Heavy chain variable region amino acid sequence

SEQ ID NO: 2227 - protein, 9 aa, Artificial Sequence
  Description of Artificial Sequence: Synthetic Heavy chain variable region CDR H1 amino acid sequence
FTFDTYAMN

SEQ ID NO: 2228 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2229 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2230 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2231 - protein, 16 aa, Artificial Sequence
  Description of Artificial Sequence: Synthetic Heavy chain variable region CDR H3 amino acid sequence
VRHSNFGNSYVSWFAH

SEQ ID NO: 2232 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2233 - DNA, 327 bp, Artificial Sequence; identical to SEQ ID NO: 1801
  Description of Artificial Sequence: Synthetic Light chain variable region nucleic acid sequence

SEQ ID NO: 2234 - protein, 109 aa, Artificial Sequence; identical to SEQ ID NO: 1802
  Description of Artificial Sequence: Synthetic Light chain variable region amino acid sequence

SEQ ID NO: 2235 - protein, 14 aa, Artificial Sequence
  Description of Artificial Sequence: Synthetic Light chain variable region CDR L1 amino acid sequence
GSSAGAVTTSNYAN

SEQ ID NO: 2236 - DNA, 42 bp, Artificial Sequence; identical to SEQ ID NO: 236
  Description of Artificial Sequence: Synthetic Light chain variable region CDR L1 nucleic acid sequence

SEQ ID NO: 2237 - protein, 7 aa, Artificial Sequence
  Description of Artificial Sequence: Synthetic Light chain variable region CDR L2 amino acid sequence
GTDKRAP

SEQ ID NO: 2238 - DNA, 21 bp, Artificial Sequence
  Description of Artificial Sequence: Synthetic Light chain variable region CDR L2 nucleic acid sequence
ggcacagacaagcgcgctcct

SEQ ID NO: 2239 - protein, 9 aa, Artificial Sequence
  Description of Artificial Sequence: Synthetic Light chain variable region CDR L3 amino acid sequence
ALWYSNLWV

SEQ ID NO: 2240 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2241 - DNA, 375 bp, Artificial Sequence; identical to SEQ ID NO: 145
  Description of Artificial Sequence: Synthetic Heavy chain variable region nucleic acid sequence

SEQ ID NO: 2242 - protein, 125 aa, Artificial Sequence; identical to SEQ ID NO: 146
  Description of Artificial Sequence: Synthetic Heavy chain variable region amino acid sequence

SEQ ID NO: 2243 - protein, 9 aa, Artificial Sequence
  Description of Artificial Sequence: Synthetic Heavy chain variable region CDR H1 amino acid sequence
FTFDTYAMN

SEQ ID NO: 2244 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2245 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2246 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2247 - protein, 16 aa, Artificial Sequence
  Description of Artificial Sequence: Synthetic Heavy chain variable region CDR H3 amino acid sequence
VRHSNFGNSYVSWFAH

SEQ ID NO: 2248 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2249 - DNA, 327 bp, Artificial Sequence; identical to SEQ ID NO: 1817
  Description of Artificial Sequence: Synthetic Light chain variable region nucleic acid sequence

SEQ ID NO: 2250 - protein, 109 aa, Artificial Sequence; identical to SEQ ID NO: 1818
  Description of Artificial Sequence: Synthetic Light chain variable region amino acid sequence

SEQ ID NO: 2251 - protein, 14 aa, Artificial Sequence
  Description of Artificial Sequence: Synthetic Light chain variable region CDR L1 amino acid sequence
GSSTGAVTTSNYAN

SEQ ID NO: 2252 - DNA, 42 bp, Artificial Sequence; identical to SEQ ID NO: 204
  Description of Artificial Sequence: Synthetic Light chain variable region CDR L1 nucleic acid sequence

SEQ ID NO: 2253 - protein, 7 aa, Artificial Sequence
  Description of Artificial Sequence: Synthetic Light chain variable region CDR L2 amino acid sequence
GTDKRAP

SEQ ID NO: 2254 - DNA, 21 bp, Artificial Sequence
  Description of Artificial Sequence: Synthetic Light chain variable region CDR L2 nucleic acid sequence
ggcacagacaagcgcgctcct

SEQ ID NO: 2255 - protein, 9 aa, Artificial Sequence
  Description of Artificial Sequence: Synthetic Light chain variable region CDR L3 amino acid sequence
ALWYNNLWV

SEQ ID NO: 2256 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 2257 - DNA, 375 bp, Artificial Sequence; identical to SEQ ID NO: 145
  Description of Artificial Sequence: Synthetic Heavy chain variable region nucleic acid sequence

SEQ ID NO: 2258 - protein, 125 aa, Artificial Sequence; identical to SEQ ID NO: 146
  Description of Artificial Sequence: Synthetic Heavy chain variable region amino acid sequence

SEQ ID NO: 2259 - protein, 9 aa, Artificial Sequence
  Description of Artificial Sequence: Synthetic Heavy chain variable region CDR H1 amino acid sequence
FTFDTYAMN

SEQ ID NO: 2260 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2261 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2262 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2263 - protein, 16 aa, Artificial Sequence
  Description of Artificial Sequence: Synthetic Heavy chain variable region CDR H3 amino acid sequence
VRHSNFGNSYVSWFAH

SEQ ID NO: 2264 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2265 - DNA, 327 bp, Artificial Sequence; identical to SEQ ID NO: 1833
  Description of Artificial Sequence: Synthetic Light chain variable region nucleic acid sequence

SEQ ID NO: 2266 - protein, 109 aa, Artificial Sequence; identical to SEQ ID NO: 1834
  Description of Artificial Sequence: Synthetic Light chain variable region amino acid sequence

SEQ ID NO: 2267 - protein, 14 aa, Artificial Sequence
  Description of Artificial Sequence: Synthetic Light chain variable region CDR L1 amino acid sequence
GSSTGAVTTSNYAN

SEQ ID NO: 2268 - DNA, 42 bp, Artificial Sequence; identical to SEQ ID NO: 204
  Description of Artificial Sequence: Synthetic Light chain variable region CDR L1 nucleic acid sequence

SEQ ID NO: 2269 - protein, 7 aa, Artificial Sequence
  Description of Artificial Sequence: Synthetic Light chain variable region CDR L2 amino acid sequence
GTDKRAP

SEQ ID NO: 2270 - DNA, 21 bp, Artificial Sequence
  Description of Artificial Sequence: Synthetic Light chain variable region CDR L2 nucleic acid sequence
ggcacagacaagcgcgctcct

SEQ ID NO: 2271 - protein, 9 aa, Artificial Sequence
  Description of Artificial Sequence: Synthetic Light chain variable region CDR L3 amino acid sequence
VLWYSNLWV

SEQ ID NO: 2272 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 2273 - DNA, 375 bp, Artificial Sequence; identical to SEQ ID NO: 145
  Description of Artificial Sequence: Synthetic Heavy chain variable region nucleic acid sequence

SEQ ID NO: 2274 - protein, 125 aa, Artificial Sequence; identical to SEQ ID NO: 146
  Description of Artificial Sequence: Synthetic Heavy chain variable region amino acid sequence

SEQ ID NO: 2275 - protein, 9 aa, Artificial Sequence
  Description of Artificial Sequence: Synthetic Heavy chain variable region CDR H1 amino acid sequence
FTFDTYAMN

SEQ ID NO: 2276 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2277 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2278 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2279 - protein, 16 aa, Artificial Sequence
  Description of Artificial Sequence: Synthetic Heavy chain variable region CDR H3 amino acid sequence
VRHSNFGNSYVSWFAH

SEQ ID NO: 2280 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2281 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagatgatgaagctgattattactgtgcgctgtggtacagtaaccattgggtgttcggcggagggaccaagctgaccgtccta

SEQ ID NO: 2282 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQADDEADYYCALWYSNHWVFGGGTKLTVL

SEQ ID NO: 2283 - protein, 14 aa, Artificial Sequence
  Description of Artificial Sequence: Synthetic Light chain variable region CDR L1 amino acid sequence
GSSTGAVTTSNYAN

SEQ ID NO: 2284 - DNA, 42 bp, Artificial Sequence; identical to SEQ ID NO: 204
  Description of Artificial Sequence: Synthetic Light chain variable region CDR L1 nucleic acid sequence

SEQ ID NO: 2285 - protein, 7 aa, Artificial Sequence
  Description of Artificial Sequence: Synthetic Light chain variable region CDR L2 amino acid sequence
GTDKRAP

SEQ ID NO: 2286 - DNA, 21 bp, Artificial Sequence
  Description of Artificial Sequence: Synthetic Light chain variable region CDR L2 nucleic acid sequence
ggcacagacaagcgcgctcct

SEQ ID NO: 2287 - protein, 9 aa, Artificial Sequence
  Description of Artificial Sequence: Synthetic Light chain variable region CDR L3 amino acid sequence
ALWYSNHWV

SEQ ID NO: 2288 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 2289 - DNA, 375 bp, Artificial Sequence; identical to SEQ ID NO: 17
  Description of Artificial Sequence: Synthetic Heavy chain variable region nucleic acid sequence

SEQ ID NO: 2290 - protein, 125 aa, Artificial Sequence; identical to SEQ ID NO: 18
  Description of Artificial Sequence: Synthetic Heavy chain variable region amino acid sequence

SEQ ID NO: 2291 - protein, 9 aa, Artificial Sequence
  Description of Artificial Sequence: Synthetic Heavy chain variable region CDR H1 amino acid sequence
FTFDTYAMN

SEQ ID NO: 2292 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2293 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2294 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2295 - protein, 16 aa, Artificial Sequence
  Description of Artificial Sequence: Synthetic Heavy chain variable region CDR H3 amino acid sequence
VRHGNFGNGYVSWFAH

SEQ ID NO: 2296 - DNA, 48 bp, Artificial Sequence; identical to SEQ ID NO: 24
  Description of Artificial Sequence: Synthetic Heavy chain variable region CDR H3 nucleic acid sequence

SEQ ID NO: 2297 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcatcatcacgggggtccaggcagatgatgaagctgattattactgtgcgctgtggtacagtaacctttgggtgttcggcggagggaccaagctgaccgtccta

SEQ ID NO: 2298 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALIITGVQADDEADYYCALWYSNLWVFGGGTKLTVL

SEQ ID NO: 2299 - protein, 14 aa, Artificial Sequence
  Description of Artificial Sequence: Synthetic Light chain variable region CDR L1 amino acid sequence
GSSTGAVTTSNYAN

SEQ ID NO: 2300 - DNA, 42 bp, Artificial Sequence; identical to SEQ ID NO: 204
  Description of Artificial Sequence: Synthetic Light chain variable region CDR L1 nucleic acid sequence

SEQ ID NO: 2301 - protein, 7 aa, Artificial Sequence
  Description of Artificial Sequence: Synthetic Light chain variable region CDR L2 amino acid sequence
GTDKRAP

SEQ ID NO: 2302 - DNA, 21 bp, Artificial Sequence
  Description of Artificial Sequence: Synthetic Light chain variable region CDR L2 nucleic acid sequence
ggcacagacaagcgcgctcct

SEQ ID NO: 2303 - protein, 9 aa, Artificial Sequence
  Description of Artificial Sequence: Synthetic Light chain variable region CDR L3 amino acid sequence
ALWYSNLWV

SEQ ID NO: 2304 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2305 - DNA, 375 bp, Artificial Sequence; identical to SEQ ID NO: 17
  Description of Artificial Sequence: Synthetic Heavy chain variable region nucleic acid sequence

SEQ ID NO: 2306 - protein, 125 aa, Artificial Sequence; identical to SEQ ID NO: 18
  Description of Artificial Sequence: Synthetic Heavy chain variable region amino acid sequence

SEQ ID NO: 2307 - protein, 9 aa, Artificial Sequence
  Description of Artificial Sequence: Synthetic Heavy chain variable region CDR H1 amino acid sequence
FTFDTYAMN

SEQ ID NO: 2308 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2309 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2310 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2311 - protein, 16 aa, Artificial Sequence
  Description of Artificial Sequence: Synthetic Heavy chain variable region CDR H3 amino acid sequence
VRHGNFGNGYVSWFAH

SEQ ID NO: 2312 - DNA, 48 bp, Artificial Sequence; identical to SEQ ID NO: 24
  Description of Artificial Sequence: Synthetic Heavy chain variable region CDR H3 nucleic acid sequence

SEQ ID NO: 2313 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcatcatcacgggggcccaggcagatgatgaagctgattattactgtgcgctgtggtacaataacctttgggtgttcggcggagggaccaagctgaccgtccta

SEQ ID NO: 2314 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALIITGAQADDEADYYCALWYNNLWVFGGGTKLTVL

SEQ ID NO: 2315 - protein, 14 aa, Artificial Sequence
  Description of Artificial Sequence: Synthetic Light chain variable region CDR L1 amino acid sequence
GSSTGAVTTSNYAN

SEQ ID NO: 2316 - DNA, 42 bp, Artificial Sequence; identical to SEQ ID NO: 204
  Description of Artificial Sequence: Synthetic Light chain variable region CDR L1 nucleic acid sequence

SEQ ID NO: 2317 - protein, 7 aa, Artificial Sequence
  Description of Artificial Sequence: Synthetic Light chain variable region CDR L2 amino acid sequence
GTDKRAP

SEQ ID NO: 2318 - DNA, 21 bp, Artificial Sequence
  Description of Artificial Sequence: Synthetic Light chain variable region CDR L2 nucleic acid sequence
ggcacagacaagcgcgctcct

SEQ ID NO: 2319 - protein, 9 aa, Artificial Sequence
  Description of Artificial Sequence: Synthetic Light chain variable region CDR L3 amino acid sequence
ALWYNNLWV

SEQ ID NO: 2320 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 2321 - DNA, 375 bp, Artificial Sequence; identical to SEQ ID NO: 17
  Description of Artificial Sequence: Synthetic Heavy chain variable region nucleic acid sequence

SEQ ID NO: 2322 - protein, 125 aa, Artificial Sequence; identical to SEQ ID NO: 18
  Description of Artificial Sequence: Synthetic Heavy chain variable region amino acid sequence

SEQ ID NO: 2323 - protein, 9 aa, Artificial Sequence
  Description of Artificial Sequence: Synthetic Heavy chain variable region CDR H1 amino acid sequence
FTFDTYAMN

SEQ ID NO: 2324 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2325 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2326 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2327 - protein, 16 aa, Artificial Sequence
  Description of Artificial Sequence: Synthetic Heavy chain variable region CDR H3 amino acid sequence
VRHGNFGNGYVSWFAH

SEQ ID NO: 2328 - DNA, 48 bp, Artificial Sequence; identical to SEQ ID NO: 24
  Description of Artificial Sequence: Synthetic Heavy chain variable region CDR H3 nucleic acid sequence

SEQ ID NO: 2329 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagatgatgaagctgattattactgtgtgctgtggtacaataacctttgggtgttcggcggagggaccaagctgaccgtccta

SEQ ID NO: 2330 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQADDEADYYCVLWYNNLWVFGGGTKLTVL

SEQ ID NO: 2331 - protein, 14 aa, Artificial Sequence
  Description of Artificial Sequence: Synthetic Light chain variable region CDR L1 amino acid sequence
GSSTGAVTTSNYAN

SEQ ID NO: 2332 - DNA, 42 bp, Artificial Sequence; identical to SEQ ID NO: 204
  Description of Artificial Sequence: Synthetic Light chain variable region CDR L1 nucleic acid sequence

SEQ ID NO: 2333 - protein, 7 aa, Artificial Sequence
  Description of Artificial Sequence: Synthetic Light chain variable region CDR L2 amino acid sequence
GTDKRAP

SEQ ID NO: 2334 - DNA, 21 bp, Artificial Sequence
  Description of Artificial Sequence: Synthetic Light chain variable region CDR L2 nucleic acid sequence
ggcacagacaagcgcgctcct

SEQ ID NO: 2335 - protein, 9 aa, Artificial Sequence
  Description of Artificial Sequence: Synthetic Light chain variable region CDR L3 amino acid sequence
VLWYNNLWV

SEQ ID NO: 2336 - DNA, 27 bp, Artificial Sequence
  Description of Artificial Sequence: Synthetic Light chain variable region CDR L3 nucleic acid sequence
gtgctgtggtacaataacctttgggtg

SEQ ID NO: 2337 - DNA, 375 bp, Artificial Sequence; identical to SEQ ID NO: 65
  Description of Artificial Sequence: Synthetic Heavy chain variable region nucleic acid sequence

SEQ ID NO: 2338 - protein, 125 aa, Artificial Sequence; identical to SEQ ID NO: 66
  Description of Artificial Sequence: Synthetic Heavy chain variable region amino acid sequence

SEQ ID NO: 2339 - protein, 9 aa, Artificial Sequence
  Description of Artificial Sequence: Synthetic Heavy chain variable region CDR H1 amino acid sequence
FTFDTYAMN

SEQ ID NO: 2340 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2341 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2342 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2343 - protein, 16 aa, Artificial Sequence
  Description of Artificial Sequence: Synthetic Heavy chain variable region CDR H3 amino acid sequence
VRHGNFGNSYVSWFAH

SEQ ID NO: 2344 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2345 - DNA, 327 bp, Artificial Sequence
  Description of Artificial Sequence: Synthetic Light chain variable region nucleic acid sequence
agacatgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcccagacaagcgcgctcctggggtccctgatcgcttctctggctccctgcttggggacaaagctgccctcatcatcacgggggtccaggcagatgatgaagctgattattactgtgcgctgtggtacagtaacctttgggtgttcggcggagggaccaagctgaccgtccta

SEQ ID NO: 2346 - protein, 109 aa, Artificial Sequence
  Description of Artificial Sequence: Synthetic Light chain variable region amino acid sequence
RHVVTQEPSLSVSPGGTVTLTCGSSTGAVTTSNYANWVQQTPGQAPRGLIGGPDKRAPGVPDRFSGSLLGDKAALIITGVQADDEADYYCALWYSNLWVFGGGTKLTVL

SEQ ID NO: 2347 - protein, 14 aa, Artificial Sequence
  Description of Artificial Sequence: Synthetic Light chain variable region CDR L1 amino acid sequence
GSSTGAVTTSNYAN

SEQ ID NO: 2348 - DNA, 42 bp, Artificial Sequence; identical to SEQ ID NO: 204
  Description of Artificial Sequence: Synthetic Light chain variable region CDR L1 nucleic acid sequence

SEQ ID NO: 2349 - protein, 7 aa, Artificial Sequence
  Description of Artificial Sequence: Synthetic Light chain variable region CDR L2 amino acid sequence
GPDKRAP

SEQ ID NO: 2350 - DNA, 21 bp, Artificial Sequence
  Description of Artificial Sequence: Synthetic Light chain variable region CDR L2 nucleic acid sequence
ggcccagacaagcgcgctcct

SEQ ID NO: 2351 - protein, 9 aa, Artificial Sequence
  Description of Artificial Sequence: Synthetic Light chain variable region CDR L3 amino acid sequence
ALWYSNLWV

SEQ ID NO: 2352 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2353 - DNA, 375 bp, Artificial Sequence; identical to SEQ ID NO: 145
  Description of Artificial Sequence: Synthetic Heavy chain variable region nucleic acid sequence

SEQ ID NO: 2354 - protein, 125 aa, Artificial Sequence; identical to SEQ ID NO: 146
  Description of Artificial Sequence: Synthetic Heavy chain variable region amino acid sequence

SEQ ID NO: 2355 - protein, 9 aa, Artificial Sequence
  Description of Artificial Sequence: Synthetic Heavy chain variable region CDR H1 amino acid sequence
FTFDTYAMN

SEQ ID NO: 2356 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2357 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2358 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2359 - protein, 16 aa, Artificial Sequence
  Description of Artificial Sequence: Synthetic Heavy chain variable region CDR H3 amino acid sequence
VRHSNFGNSYVSWFAH

SEQ ID NO: 2360 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2361 - DNA, 327 bp, Artificial Sequence
  Description of Artificial Sequence: Synthetic Light chain variable region nucleic acid sequence
agaactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagatgatgaagctgattattactgtgtgctgtggtacaataacctttgggtgttcggcggagggaccaagctgaccgtccta

SEQ ID NO: 2362 - protein, 109 aa, Artificial Sequence
  Description of Artificial Sequence: Synthetic Light chain variable region amino acid sequence
RTVVTQEPSLSVSPGGTVTLTCGSSTGAVTTSNYANWVQQTPGQAPRGLIGGTDKRAPGVPDRFSGSLLGDKAALTITGAQADDEADYYCVLWYNNLWVFGGGTKLTVL

SEQ ID NO: 2363 - protein, 14 aa, Artificial Sequence
  Description of Artificial Sequence: Synthetic Light chain variable region CDR L1 amino acid sequence
GSSTGAVTTSNYAN

SEQ ID NO: 2364 - DNA, 42 bp, Artificial Sequence; identical to SEQ ID NO: 204
  Description of Artificial Sequence: Synthetic Light chain variable region CDR L1 nucleic acid sequence

SEQ ID NO: 2365 - protein, 7 aa, Artificial Sequence
  Description of Artificial Sequence: Synthetic Light chain variable region CDR L2 amino acid sequence
GTDKRAP

SEQ ID NO: 2366 - DNA, 21 bp, Artificial Sequence
  Description of Artificial Sequence: Synthetic Light chain variable region CDR L2 nucleic acid sequence
ggcacagacaagcgcgctcct

SEQ ID NO: 2367 - protein, 9 aa, Artificial Sequence
  Description of Artificial Sequence: Synthetic Light chain variable region CDR L3 amino acid sequence
VLWYNNLWV

SEQ ID NO: 2368 - DNA, 27 bp, Artificial Sequence
  Description of Artificial Sequence: Synthetic Light chain variable region CDR L3 nucleic acid sequence
gtgctgtggtacaataacctttgggtg

SEQ ID NO: 2369 - DNA, 375 bp, Artificial Sequence; identical to SEQ ID NO: 65
  Description of Artificial Sequence: Synthetic Heavy chain variable region nucleic acid sequence

SEQ ID NO: 2370 - protein, 125 aa, Artificial Sequence; identical to SEQ ID NO: 66
  Description of Artificial Sequence: Synthetic Heavy chain variable region amino acid sequence

SEQ ID NO: 2371 - protein, 9 aa, Artificial Sequence
  Description of Artificial Sequence: Synthetic Heavy chain variable region CDR H1 amino acid sequence
FTFDTYAMN

SEQ ID NO: 2372 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2373 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2374 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2375 - protein, 16 aa, Artificial Sequence
  Description of Artificial Sequence: Synthetic Heavy chain variable region CDR H3 amino acid sequence
VRHGNFGNSYVSWFAH

SEQ ID NO: 2376 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2377 - DNA, 327 bp, Artificial Sequence; identical to SEQ ID NO: 1737
  Description of Artificial Sequence: Synthetic Light chain variable region nucleic acid sequence

SEQ ID NO: 2378 - protein, 109 aa, Artificial Sequence; identical to SEQ ID NO: 1738
  Description of Artificial Sequence: Synthetic Light chain variable region amino acid sequence

SEQ ID NO: 2379 - protein, 14 aa, Artificial Sequence
  Description of Artificial Sequence: Synthetic Light chain variable region CDR L1 amino acid sequence
GSSAGAVTTSNYAN

SEQ ID NO: 2380 - DNA, 42 bp, Artificial Sequence; identical to SEQ ID NO: 236
  Description of Artificial Sequence: Synthetic Light chain variable region CDR L1 nucleic acid sequence

SEQ ID NO: 2381 - protein, 7 aa, Artificial Sequence
  Description of Artificial Sequence: Synthetic Light chain variable region CDR L2 amino acid sequence
GTDKRAP

SEQ ID NO: 2382 - DNA, 21 bp, Artificial Sequence
  Description of Artificial Sequence: Synthetic Light chain variable region CDR L2 nucleic acid sequence
ggcacagacaagcgcgctcct

SEQ ID NO: 2383 - protein, 9 aa, Artificial Sequence
  Description of Artificial Sequence: Synthetic Light chain variable region CDR L3 amino acid sequence
ALWYSNLWV

SEQ ID NO: 2384 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2385 - DNA, 375 bp, Artificial Sequence; identical to SEQ ID NO: 17
  Description of Artificial Sequence: Synthetic Heavy chain variable region nucleic acid sequence

SEQ ID NO: 2386 - protein, 125 aa, Artificial Sequence; identical to SEQ ID NO: 18
  Description of Artificial Sequence: Synthetic Heavy chain variable region amino acid sequence

SEQ ID NO: 2387 - protein, 9 aa, Artificial Sequence
  Description of Artificial Sequence: Synthetic Heavy chain variable region CDR H1 amino acid sequence
FTFDTYAMN

SEQ ID NO: 2388 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2389 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2390 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2391 - protein, 16 aa, Artificial Sequence
  Description of Artificial Sequence: Synthetic Heavy chain variable region CDR H3 amino acid sequence
VRHGNFGNGYVSWFAH

SEQ ID NO: 2392 - DNA, 48 bp, Artificial Sequence; identical to SEQ ID NO: 24
  Description of Artificial Sequence: Synthetic Heavy chain variable region CDR H3 nucleic acid sequence

SEQ ID NO: 2393 - DNA, 327 bp, Artificial Sequence; identical to SEQ ID NO: 1257
  Description of Artificial Sequence: Synthetic Light chain variable region nucleic acid sequence

SEQ ID NO: 2394 - protein, 109 aa, Artificial Sequence; identical to SEQ ID NO: 1258
  Description of Artificial Sequence: Synthetic Light chain variable region amino acid sequence

SEQ ID NO: 2395 - protein, 14 aa, Artificial Sequence
  Description of Artificial Sequence: Synthetic Light chain variable region CDR L1 amino acid sequence
GSSTGAVTTSNYAN

SEQ ID NO: 2396 - DNA, 42 bp, Artificial Sequence; identical to SEQ ID NO: 204
  Description of Artificial Sequence: Synthetic Light chain variable region CDR L1 nucleic acid sequence

SEQ ID NO: 2397 - protein, 7 aa, Artificial Sequence
  Description of Artificial Sequence: Synthetic Light chain variable region CDR L2 amino acid sequence
GTDKRAP

SEQ ID NO: 2398 - DNA, 21 bp, Artificial Sequence
  Description of Artificial Sequence: Synthetic Light chain variable region CDR L2 nucleic acid sequence
ggcacagacaagcgcgctcct

SEQ ID NO: 2399 - protein, 9 aa, Artificial Sequence
  Description of Artificial Sequence: Synthetic Light chain variable region CDR L3 amino acid sequence
ALWYSNLWV

SEQ ID NO: 2400 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2401 - DNA, 375 bp, Artificial Sequence; identical to SEQ ID NO: 17
  Description of Artificial Sequence: Synthetic Heavy chain variable region nucleic acid sequence

SEQ ID NO: 2402 - protein, 125 aa, Artificial Sequence; identical to SEQ ID NO: 18
  Description of Artificial Sequence: Synthetic Heavy chain variable region amino acid sequence

SEQ ID NO: 2403 - protein, 9 aa, Artificial Sequence
  Description of Artificial Sequence: Synthetic Heavy chain variable region CDR H1 amino acid sequence
FTFDTYAMN

SEQ ID NO: 2404 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2405 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2406 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2407 - protein, 16 aa, Artificial Sequence
  Description of Artificial Sequence: Synthetic Heavy chain variable region CDR H3 amino acid sequence
VRHGNFGNGYVSWFAH

SEQ ID NO: 2408 - DNA, 48 bp, Artificial Sequence; identical to SEQ ID NO: 24
  Description of Artificial Sequence: Synthetic Heavy chain variable region CDR H3 nucleic acid sequence

SEQ ID NO: 2409 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagaggatgaagctgattattactgtgcgctgtggtacaataacctttgggtgttcggcggagggaccaagctgaccgtccta

SEQ ID NO: 2410 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQAEDEADYYCALWYNNLWVFGGGTKLTVL

SEQ ID NO: 2411 - protein, 14 aa, Artificial Sequence
  Description of Artificial Sequence: Synthetic Light chain variable region CDR L1 amino acid sequence
GSSTGAVTTSNYAN

SEQ ID NO: 2412 - DNA, 42 bp, Artificial Sequence; identical to SEQ ID NO: 204
  Description of Artificial Sequence: Synthetic Light chain variable region CDR L1 nucleic acid sequence

SEQ ID NO: 2413 - protein, 7 aa, Artificial Sequence
  Description of Artificial Sequence: Synthetic Light chain variable region CDR L2 amino acid sequence
GTDKRAP

SEQ ID NO: 2414 - DNA, 21 bp, Artificial Sequence
  Description of Artificial Sequence: Synthetic Light chain variable region CDR L2 nucleic acid sequence
ggcacagacaagcgcgctcct

SEQ ID NO: 2415 - protein, 9 aa, Artificial Sequence
  Description of Artificial Sequence: Synthetic Light chain variable region CDR L3 amino acid sequence
ALWYNNLWV

SEQ ID NO: 2416 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 2417 - DNA, 375 bp, Artificial Sequence; identical to SEQ ID NO: 17
  Description of Artificial Sequence: Synthetic Heavy chain variable region nucleic acid sequence

SEQ ID NO: 2418 - protein, 125 aa, Artificial Sequence; identical to SEQ ID NO: 18
  Description of Artificial Sequence: Synthetic Heavy chain variable region amino acid sequence

SEQ ID NO: 2419 - protein, 9 aa, Artificial Sequence
  Description of Artificial Sequence: Synthetic Heavy chain variable region CDR H1 amino acid sequence
FTFDTYAMN

SEQ ID NO: 2420 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2421 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2422 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2423 - protein, 16 aa, Artificial Sequence
  Description of Artificial Sequence: Synthetic Heavy chain variable region CDR H3 amino acid sequence
VRHGNFGNGYVSWFAH

SEQ ID NO: 2424 - DNA, 48 bp, Artificial Sequence; identical to SEQ ID NO: 24
  Description of Artificial Sequence: Synthetic Heavy chain variable region CDR H3 nucleic acid sequence

SEQ ID NO: 2425 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcactggcgcagtcactactagtaactacgccaactgggtccagcagaccccaggccaggctccgcgcggactcatcggcggcacagacaagcgcgctcctggggtccctgatcgcttctctggctccctgcttggggacaaagctgccctcaccatcacgggggcccaggcagatgatgaagctgattattactgtgtgctgtggtacagtaaccattgggtgttcggcggagggaccaagctgaccgtccta

SEQ ID NO: 2426 - protein, 109 aa, Artificial Sequence
  Description of Artificial Sequence: Synthetic Light chain variable region amino acid sequence
QTVVTQEPSLSVSPGGTVTLTCGSSTGAVTTSNYANWVQQTPGQAPRGLIGGTDKRAPGVPDRFSGSLLGDKAALTITGAQADDEADYYCVLWYSNHWVFGGGTKLTVL

SEQ ID NO: 2427 - protein, 14 aa, Artificial Sequence
  Description of Artificial Sequence: Synthetic Light chain variable region CDR L1 amino acid sequence
GSSTGAVTTSNYAN

SEQ ID NO: 2428 - DNA, 42 bp, Artificial Sequence; identical to SEQ ID NO: 204
  Description of Artificial Sequence: Synthetic Light chain variable region CDR L1 nucleic acid sequence

SEQ ID NO: 2429 - protein, 7 aa, Artificial Sequence
  Description of Artificial Sequence: Synthetic Light chain variable region CDR L2 amino acid sequence
GTDKRAP

SEQ ID NO: 2430 - DNA, 21 bp, Artificial Sequence
  Description of Artificial Sequence: Synthetic Light chain variable region CDR L2 nucleic acid sequence
ggcacagacaagcgcgctcct

SEQ ID NO: 2431 - protein, 9 aa, Artificial Sequence
  Description of Artificial Sequence: Synthetic Light chain variable region CDR L3 amino acid sequence
VLWYSNHWV

SEQ ID NO: 2432 - DNA, 27 bp, Artificial Sequence
  Description of Artificial Sequence: Synthetic Light chain variable region CDR L3 nucleic acid sequence
gtgctgtggtacagtaaccattgggtg

SEQ ID NO: 2433 - DNA, 375 bp, Artificial Sequence; identical to SEQ ID NO: 17
  Description of Artificial Sequence: Synthetic Heavy chain variable region nucleic acid sequence

SEQ ID NO: 2434 - protein, 125 aa, Artificial Sequence; identical to SEQ ID NO: 18
  Description of Artificial Sequence: Synthetic Heavy chain variable region amino acid sequence

SEQ ID NO: 2435 - protein, 9 aa, Artificial Sequence
  Description of Artificial Sequence: Synthetic Heavy chain variable region CDR H1 amino acid sequence
FTFDTYAMN

SEQ ID NO: 2436 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2437 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2438 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2439 - protein, 16 aa, Artificial Sequence
  Description of Artificial Sequence: Synthetic Heavy chain variable region CDR H3 amino acid sequence
VRHGNFGNGYVSWFAH

SEQ ID NO: 2440 - DNA, 48 bp, Artificial Sequence; identical to SEQ ID NO: 24
  Description of Artificial Sequence: Synthetic Heavy chain variable region CDR H3 nucleic acid sequence

SEQ ID NO: 2441 - DNA, 327 bp, Artificial Sequence; identical to SEQ ID NO: 2281
  Description of Artificial Sequence: Synthetic Light chain variable region nucleic acid sequence

SEQ ID NO: 2442 - protein, 109 aa, Artificial Sequence; identical to SEQ ID NO: 2282
  Description of Artificial Sequence: Synthetic Light chain variable region amino acid sequence

SEQ ID NO: 2443 - protein, 14 aa, Artificial Sequence
  Description of Artificial Sequence: Synthetic Light chain variable region CDR L1 amino acid sequence
GSSTGAVTTSNYAN

SEQ ID NO: 2444 - DNA, 42 bp, Artificial Sequence; identical to SEQ ID NO: 204
  Description of Artificial Sequence: Synthetic Light chain variable region CDR L1 nucleic acid sequence

SEQ ID NO: 2445 - protein, 7 aa, Artificial Sequence
  Description of Artificial Sequence: Synthetic Light chain variable region CDR L2 amino acid sequence
GTDKRAP

SEQ ID NO: 2446 - DNA, 21 bp, Artificial Sequence
  Description of Artificial Sequence: Synthetic Light chain variable region CDR L2 nucleic acid sequence
ggcacagacaagcgcgctcct

SEQ ID NO: 2447 - protein, 9 aa, Artificial Sequence
  Description of Artificial Sequence: Synthetic Light chain variable region CDR L3 amino acid sequence
ALWYSNHWV

SEQ ID NO: 2448 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 2449 - DNA, 375 bp, Artificial Sequence; identical to SEQ ID NO: 65
  Description of Artificial Sequence: Synthetic Heavy chain variable region nucleic acid sequence

SEQ ID NO: 2450 - protein, 125 aa, Artificial Sequence; identical to SEQ ID NO: 66
  Description of Artificial Sequence: Synthetic Heavy chain variable region amino acid sequence

SEQ ID NO: 2451 - protein, 9 aa, Artificial Sequence
  Description of Artificial Sequence: Synthetic Heavy chain variable region CDR H1 amino acid sequence
FTFDTYAMN

SEQ ID NO: 2452 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2453 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2454 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2455 - protein, 16 aa, Artificial Sequence
  Description of Artificial Sequence: Synthetic Heavy chain variable region CDR H3 amino acid sequence
VRHGNFGNSYVSWFAH

SEQ ID NO: 2456 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2457 - DNA, 327 bp, Artificial Sequence; identical to SEQ ID NO: 265
  Description of Artificial Sequence: Synthetic Light chain variable region nucleic acid sequence

SEQ ID NO: 2458 - protein, 109 aa, Artificial Sequence; identical to SEQ ID NO: 266
  Description of Artificial Sequence: Synthetic Light chain variable region amino acid sequence

SEQ ID NO: 2459 - protein, 14 aa, Artificial Sequence
  Description of Artificial Sequence: Synthetic Light chain variable region CDR L1 amino acid sequence
GSSTGAVTTSNYAN

SEQ ID NO: 2460 - DNA, 42 bp, Artificial Sequence; identical to SEQ ID NO: 204
  Description of Artificial Sequence: Synthetic Light chain variable region CDR L1 nucleic acid sequence

SEQ ID NO: 2461 - protein, 7 aa, Artificial Sequence
  Description of Artificial Sequence: Synthetic Light chain variable region CDR L2 amino acid sequence
GTDKRAP

SEQ ID NO: 2462 - DNA, 21 bp, Artificial Sequence
  Description of Artificial Sequence: Synthetic Light chain variable region CDR L2 nucleic acid sequence
ggcacagacaagcgcgctcct

SEQ ID NO: 2463 - protein, 9 aa, Artificial Sequence
  Description of Artificial Sequence: Synthetic Light chain variable region CDR L3 amino acid sequence
ALWYNNHWV

SEQ ID NO: 2464 - DNA, 27 bp, Artificial Sequence
  Description of Artificial Sequence: Synthetic Light chain variable region CDR L3 nucleic acid sequence
gcgctgtggtacaataaccattgggtg

SEQ ID NO: 2465 - DNA, 375 bp, Artificial Sequence; identical to SEQ ID NO: 65
  Description of Artificial Sequence: Synthetic Heavy chain variable region nucleic acid sequence

SEQ ID NO: 2466 - protein, 125 aa, Artificial Sequence; identical to SEQ ID NO: 66
  Description of Artificial Sequence: Synthetic Heavy chain variable region amino acid sequence

SEQ ID NO: 2467 - protein, 9 aa, Artificial Sequence
  Description of Artificial Sequence: Synthetic Heavy chain variable region CDR H1 amino acid sequence
FTFDTYAMN

SEQ ID NO: 2468 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2469 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2470 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2471 - protein, 16 aa, Artificial Sequence
  Description of Artificial Sequence: Synthetic Heavy chain variable region CDR H3 amino acid sequence
VRHGNFGNSYVSWFAH

SEQ ID NO: 2472 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2473 - DNA, 327 bp, Artificial Sequence; identical to SEQ ID NO: 361
  Description of Artificial Sequence: Synthetic Light chain variable region nucleic acid sequence

SEQ ID NO: 2474 - protein, 109 aa, Artificial Sequence; identical to SEQ ID NO: 362
  Description of Artificial Sequence: Synthetic Light chain variable region amino acid sequence

SEQ ID NO: 2475 - protein, 14 aa, Artificial Sequence
  Description of Artificial Sequence: Synthetic Light chain variable region CDR L1 amino acid sequence
GSSAGAVTTSNYAN

SEQ ID NO: 2476 - DNA, 42 bp, Artificial Sequence; identical to SEQ ID NO: 236
  Description of Artificial Sequence: Synthetic Light chain variable region CDR L1 nucleic acid sequence

SEQ ID NO: 2477 - protein, 7 aa, Artificial Sequence
  Description of Artificial Sequence: Synthetic Light chain variable region CDR L2 amino acid sequence
GTDKRAP

SEQ ID NO: 2478 - DNA, 21 bp, Artificial Sequence
  Description of Artificial Sequence: Synthetic Light chain variable region CDR L2 nucleic acid sequence
ggcacagacaagcgcgctcct

SEQ ID NO: 2479 - protein, 9 aa, Artificial Sequence
  Description of Artificial Sequence: Synthetic Light chain variable region CDR L3 amino acid sequence
ALWYSNLWV

SEQ ID NO: 2480 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2481 - DNA, 375 bp, Artificial Sequence; identical to SEQ ID NO: 65
  Description of Artificial Sequence: Synthetic Heavy chain variable region nucleic acid sequence

SEQ ID NO: 2482 - protein, 125 aa, Artificial Sequence; identical to SEQ ID NO: 66
  Description of Artificial Sequence: Synthetic Heavy chain variable region amino acid sequence

SEQ ID NO: 2483 - protein, 9 aa, Artificial Sequence
  Description of Artificial Sequence: Synthetic Heavy chain variable region CDR H1 amino acid sequence
FTFDTYAMN

SEQ ID NO: 2484 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2485 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2486 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2487 - protein, 16 aa, Artificial Sequence
  Description of Artificial Sequence: Synthetic Heavy chain variable region CDR H3 amino acid sequence
VRHGNFGNSYVSWFAH

SEQ ID NO: 2488 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2489 - DNA, 327 bp, Artificial Sequence; identical to SEQ ID NO: 2313
  Description of Artificial Sequence: Synthetic Light chain variable region nucleic acid sequence

SEQ ID NO: 2490 - protein, 109 aa, Artificial Sequence; identical to SEQ ID NO: 2314
  Description of Artificial Sequence: Synthetic Light chain variable region amino acid sequence

SEQ ID NO: 2491 - protein, 14 aa, Artificial Sequence
  Description of Artificial Sequence: Synthetic Light chain variable region CDR L1 amino acid sequence
GSSTGAVTTSNYAN

SEQ ID NO: 2492 - DNA, 42 bp, Artificial Sequence; identical to SEQ ID NO: 204
  Description of Artificial Sequence: Synthetic Light chain variable region CDR L1 nucleic acid sequence

SEQ ID NO: 2493 - protein, 7 aa, Artificial Sequence
  Description of Artificial Sequence: Synthetic Light chain variable region CDR L2 amino acid sequence
GTDKRAP

SEQ ID NO: 2494 - DNA, 21 bp, Artificial Sequence
  Description of Artificial Sequence: Synthetic Light chain variable region CDR L2 nucleic acid sequence
ggcacagacaagcgcgctcct

SEQ ID NO: 2495 - protein, 9 aa, Artificial Sequence
  Description of Artificial Sequence: Synthetic Light chain variable region CDR L3 amino acid sequence
ALWYNNLWV

SEQ ID NO: 2496 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 2497 - DNA, 375 bp, Artificial Sequence; identical to SEQ ID NO: 65
  Description of Artificial Sequence: Synthetic Heavy chain variable region nucleic acid sequence

SEQ ID NO: 2498 - protein, 125 aa, Artificial Sequence; identical to SEQ ID NO: 66
  Description of Artificial Sequence: Synthetic Heavy chain variable region amino acid sequence

SEQ ID NO: 2499 - protein, 9 aa, Artificial Sequence
  Description of Artificial Sequence: Synthetic Heavy chain variable region CDR H1 amino acid sequence
FTFDTYAMN

SEQ ID NO: 2500 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2501 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2502 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2503 - protein, 16 aa, Artificial Sequence
  Description of Artificial Sequence: Synthetic Heavy chain variable region CDR H3 amino acid sequence
VRHGNFGNSYVSWFAH

SEQ ID NO: 2504 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2505 - DNA, 327 bp, Artificial Sequence
  Description of Artificial Sequence: Synthetic Light chain variable region nucleic acid sequence
cagactgtggtgacccaggagccatcgctctcagtgtcccctggagggacagtcacactcacttgtggatcaagcgctggcgcagtcactactagtaactacgccaactgggtccagcagaccccaggccaggctccacgcggactcatcggcggcacagacaagcgcgctcctggggtccctgatcgcttctctggctccctgcttggggacaaagctgccctcaccatcacgggggcccaggcagaggatgaagctgattattactgtgcgctgtggtacagtaacctttgggtgttcggcggagggaccaagctgaccgtccta

SEQ ID NO: 2506 - protein, 109 aa, Artificial Sequence
  Description of Artificial Sequence: Synthetic Light chain variable region amino acid sequence
QTVVTQEPSLSVSPGGTVTLTCGSSAGAVTTSNYANWVQQTPGQAPRGLIGGTDKRAPGVPDRFSGSLLGDKAALTITGAQAEDEADYYCALWYSNLWVFGGGTKLTVL

SEQ ID NO: 2507 - protein, 14 aa, Artificial Sequence
  Description of Artificial Sequence: Synthetic Light chain variable region CDR L1 amino acid sequence
GSSAGAVTTSNYAN

SEQ ID NO: 2508 - DNA, 42 bp, Artificial Sequence; identical to SEQ ID NO: 236
  Description of Artificial Sequence: Synthetic Light chain variable region CDR L1 nucleic acid sequence

SEQ ID NO: 2509 - protein, 7 aa, Artificial Sequence
  Description of Artificial Sequence: Synthetic Light chain variable region CDR L2 amino acid sequence
GTDKRAP

SEQ ID NO: 2510 - DNA, 21 bp, Artificial Sequence
  Description of Artificial Sequence: Synthetic Light chain variable region CDR L2 nucleic acid sequence
ggcacagacaagcgcgctcct

SEQ ID NO: 2511 - protein, 9 aa, Artificial Sequence
  Description of Artificial Sequence: Synthetic Light chain variable region CDR L3 amino acid sequence
ALWYSNLWV

SEQ ID NO: 2512 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2513 - DNA, 375 bp, Artificial Sequence; identical to SEQ ID NO: 65
  Description of Artificial Sequence: Synthetic Heavy chain variable region nucleic acid sequence

SEQ ID NO: 2514 - protein, 125 aa, Artificial Sequence; identical to SEQ ID NO: 66
  Description of Artificial Sequence: Synthetic Heavy chain variable region amino acid sequence

SEQ ID NO: 2515 - protein, 9 aa, Artificial Sequence
  Description of Artificial Sequence: Synthetic Heavy chain variable region CDR H1 amino acid sequence
FTFDTYAMN

SEQ ID NO: 2516 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2517 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2518 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2519 - protein, 16 aa, Artificial Sequence
  Description of Artificial Sequence: Synthetic Heavy chain variable region CDR H3 amino acid sequence
VRHGNFGNSYVSWFAH

SEQ ID NO: 2520 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2521 - DNA, 327 bp, Artificial Sequence; identical to SEQ ID NO: 377
  Description of Artificial Sequence: Synthetic Light chain variable region nucleic acid sequence

SEQ ID NO: 2522 - protein, 109 aa, Artificial Sequence; identical to SEQ ID NO: 378
  Description of Artificial Sequence: Synthetic Light chain variable region amino acid sequence

SEQ ID NO: 2523 - protein, 14 aa, Artificial Sequence
  Description of Artificial Sequence: Synthetic Light chain variable region CDR L1 amino acid sequence
GSSAGAVTTSNYAN

SEQ ID NO: 2524 - DNA, 42 bp, Artificial Sequence; identical to SEQ ID NO: 236
  Description of Artificial Sequence: Synthetic Light chain variable region CDR L1 nucleic acid sequence

SEQ ID NO: 2525 - protein, 7 aa, Artificial Sequence
  Description of Artificial Sequence: Synthetic Light chain variable region CDR L2 amino acid sequence
GTDKRAP

SEQ ID NO: 2526 - DNA, 21 bp, Artificial Sequence
  Description of Artificial Sequence: Synthetic Light chain variable region CDR L2 nucleic acid sequence
ggcacagacaagcgcgctcct

SEQ ID NO: 2527 - protein, 9 aa, Artificial Sequence
  Description of Artificial Sequence: Synthetic Light chain variable region CDR L3 amino acid sequence
ALWYNNLWV

SEQ ID NO: 2528 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 2529 - DNA, 375 bp, Artificial Sequence; identical to SEQ ID NO: 65
  Description of Artificial Sequence: Synthetic Heavy chain variable region nucleic acid sequence

SEQ ID NO: 2530 - protein, 125 aa, Artificial Sequence; identical to SEQ ID NO: 66
  Description of Artificial Sequence: Synthetic Heavy chain variable region amino acid sequence

SEQ ID NO: 2531 - protein, 9 aa, Artificial Sequence
  Description of Artificial Sequence: Synthetic Heavy chain variable region CDR H1 amino acid sequence
FTFDTYAMN

SEQ ID NO: 2532 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2533 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2534 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2535 - protein, 16 aa, Artificial Sequence
  Description of Artificial Sequence: Synthetic Heavy chain variable region CDR H3 amino acid sequence
VRHGNFGNSYVSWFAH

SEQ ID NO: 2536 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2537 - DNA, 327 bp, Artificial Sequence; identical to SEQ ID NO: 1257
  Description of Artificial Sequence: Synthetic Light chain variable region nucleic acid sequence

SEQ ID NO: 2538 - protein, 109 aa, Artificial Sequence; identical to SEQ ID NO: 1258
  Description of Artificial Sequence: Synthetic Light chain variable region amino acid sequence

SEQ ID NO: 2539 - protein, 14 aa, Artificial Sequence
  Description of Artificial Sequence: Synthetic Light chain variable region CDR L1 amino acid sequence
GSSTGAVTTSNYAN

SEQ ID NO: 2540 - DNA, 42 bp, Artificial Sequence; identical to SEQ ID NO: 204
  Description of Artificial Sequence: Synthetic Light chain variable region CDR L1 nucleic acid sequence

SEQ ID NO: 2541 - protein, 7 aa, Artificial Sequence
  Description of Artificial Sequence: Synthetic Light chain variable region CDR L2 amino acid sequence
GTDKRAP

SEQ ID NO: 2542 - DNA, 21 bp, Artificial Sequence
  Description of Artificial Sequence: Synthetic Light chain variable region CDR L2 nucleic acid sequence
ggcacagacaagcgcgctcct

SEQ ID NO: 2543 - protein, 9 aa, Artificial Sequence
  Description of Artificial Sequence: Synthetic Light chain variable region CDR L3 amino acid sequence
ALWYSNLWV

SEQ ID NO: 2544 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2545 - DNA, 375 bp, Artificial Sequence; identical to SEQ ID NO: 65
  Description of Artificial Sequence: Synthetic Heavy chain variable region nucleic acid sequence

SEQ ID NO: 2546 - protein, 125 aa, Artificial Sequence; identical to SEQ ID NO: 66
  Description of Artificial Sequence: Synthetic Heavy chain variable region amino acid sequence

SEQ ID NO: 2547 - protein, 9 aa, Artificial Sequence
  Description of Artificial Sequence: Synthetic Heavy chain variable region CDR H1 amino acid sequence
FTFDTYAMN

SEQ ID NO: 2548 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2549 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2550 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2551 - protein, 16 aa, Artificial Sequence
  Description of Artificial Sequence: Synthetic Heavy chain variable region CDR H3 amino acid sequence
VRHGNFGNSYVSWFAH

SEQ ID NO: 2552 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2553 - DNA, 327 bp, Artificial Sequence; identical to SEQ ID NO: 329
  Description of Artificial Sequence: Synthetic Light chain variable region nucleic acid sequence

SEQ ID NO: 2554 - protein, 109 aa, Artificial Sequence; identical to SEQ ID NO: 330
  Description of Artificial Sequence: Synthetic Light chain variable region amino acid sequence

SEQ ID NO: 2555 - protein, 14 aa, Artificial Sequence
  Description of Artificial Sequence: Synthetic Light chain variable region CDR L1 amino acid sequence
GSSTGAVTTSNYAN

SEQ ID NO: 2556 - DNA, 42 bp, Artificial Sequence; identical to SEQ ID NO: 204
  Description of Artificial Sequence: Synthetic Light chain variable region CDR L1 nucleic acid sequence

SEQ ID NO: 2557 - protein, 7 aa, Artificial Sequence
  Description of Artificial Sequence: Synthetic Light chain variable region CDR L2 amino acid sequence
GTDKRAP

SEQ ID NO: 2558 - DNA, 21 bp, Artificial Sequence
  Description of Artificial Sequence: Synthetic Light chain variable region CDR L2 nucleic acid sequence
ggcacagacaagcgcgctcct

SEQ ID NO: 2559 - protein, 9 aa, Artificial Sequence
  Description of Artificial Sequence: Synthetic Light chain variable region CDR L3 amino acid sequence
VLWYSNLWV

SEQ ID NO: 2560 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 2561 - DNA, 375 bp, Artificial Sequence; identical to SEQ ID NO: 65
  Description of Artificial Sequence: Synthetic Heavy chain variable region nucleic acid sequence

SEQ ID NO: 2562 - protein, 125 aa, Artificial Sequence; identical to SEQ ID NO: 66
  Description of Artificial Sequence: Synthetic Heavy chain variable region amino acid sequence

SEQ ID NO: 2563 - protein, 9 aa, Artificial Sequence
  Description of Artificial Sequence: Synthetic Heavy chain variable region CDR H1 amino acid sequence
FTFDTYAMN

SEQ ID NO: 2564 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2565 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2566 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2567 - protein, 16 aa, Artificial Sequence
  Description of Artificial Sequence: Synthetic Heavy chain variable region CDR H3 amino acid sequence
VRHGNFGNSYVSWFAH

SEQ ID NO: 2568 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2569 - DNA, 327 bp, Artificial Sequence; identical to SEQ ID NO: 345
  Description of Artificial Sequence: Synthetic Light chain variable region nucleic acid sequence

SEQ ID NO: 2570 - protein, 109 aa, Artificial Sequence; identical to SEQ ID NO: 346
  Description of Artificial Sequence: Synthetic Light chain variable region amino acid sequence

SEQ ID NO: 2571 - protein, 14 aa, Artificial Sequence
  Description of Artificial Sequence: Synthetic Light chain variable region CDR L1 amino acid sequence
GSSTGAVTTSNYAN

SEQ ID NO: 2572 - DNA, 42 bp, Artificial Sequence; identical to SEQ ID NO: 204
  Description of Artificial Sequence: Synthetic Light chain variable region CDR L1 nucleic acid sequence

SEQ ID NO: 2573 - protein, 7 aa, Artificial Sequence
  Description of Artificial Sequence: Synthetic Light chain variable region CDR L2 amino acid sequence
GTDKRAP

SEQ ID NO: 2574 - DNA, 21 bp, Artificial Sequence
  Description of Artificial Sequence: Synthetic Light chain variable region CDR L2 nucleic acid sequence
ggcacagacaagcgcgctcct

SEQ ID NO: 2575 - protein, 9 aa, Artificial Sequence
  Description of Artificial Sequence: Synthetic Light chain variable region CDR L3 amino acid sequence
ALWYSNHWV

SEQ ID NO: 2576 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 2577 - DNA, 375 bp, Artificial Sequence; identical to SEQ ID NO: 65
  Description of Artificial Sequence: Synthetic Heavy chain variable region nucleic acid sequence

SEQ ID NO: 2578 - protein, 125 aa, Artificial Sequence; identical to SEQ ID NO: 66
  Description of Artificial Sequence: Synthetic Heavy chain variable region amino acid sequence

SEQ ID NO: 2579 - protein, 9 aa, Artificial Sequence
  Description of Artificial Sequence: Synthetic Heavy chain variable region CDR H1 amino acid sequence
FTFDTYAMN

SEQ ID NO: 2580 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2581 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2582 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2583 - protein, 16 aa, Artificial Sequence
  Description of Artificial Sequence: Synthetic Heavy chain variable region CDR H3 amino acid sequence
VRHGNFGNSYVSWFAH

SEQ ID NO: 2584 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2585 - DNA, 327 bp, Artificial Sequence; identical to SEQ ID NO: 2329
  Description of Artificial Sequence: Synthetic Light chain variable region nucleic acid sequence

SEQ ID NO: 2586 - protein, 109 aa, Artificial Sequence; identical to SEQ ID NO: 2330
  Description of Artificial Sequence: Synthetic Light chain variable region amino acid sequence

SEQ ID NO: 2587 - protein, 14 aa, Artificial Sequence
  Description of Artificial Sequence: Synthetic Light chain variable region CDR L1 amino acid sequence
GSSTGAVTTSNYAN

SEQ ID NO: 2588 - DNA, 42 bp, Artificial Sequence; identical to SEQ ID NO: 204
  Description of Artificial Sequence: Synthetic Light chain variable region CDR L1 nucleic acid sequence

SEQ ID NO: 2589 - protein, 7 aa, Artificial Sequence
  Description of Artificial Sequence: Synthetic Light chain variable region CDR L2 amino acid sequence
GTDKRAP

SEQ ID NO: 2590 - DNA, 21 bp, Artificial Sequence
  Description of Artificial Sequence: Synthetic Light chain variable region CDR L2 nucleic acid sequence
ggcacagacaagcgcgctcct

SEQ ID NO: 2591 - protein, 9 aa, Artificial Sequence
  Description of Artificial Sequence: Synthetic Light chain variable region CDR L3 amino acid sequence
VLWYNNLWV

SEQ ID NO: 2592 - DNA, 27 bp, Artificial Sequence
  Description of Artificial Sequence: Synthetic Light chain variable region CDR L3 nucleic acid sequence
gtgctgtggtacaataacctttgggtg

SEQ ID NO: 2593 - DNA, 375 bp, Artificial Sequence; identical to SEQ ID NO: 65
  Description of Artificial Sequence: Synthetic Heavy chain variable region nucleic acid sequence

SEQ ID NO: 2594 - protein, 125 aa, Artificial Sequence; identical to SEQ ID NO: 66
  Description of Artificial Sequence: Synthetic Heavy chain variable region amino acid sequence

SEQ ID NO: 2595 - protein, 9 aa, Artificial Sequence
  Description of Artificial Sequence: Synthetic Heavy chain variable region CDR H1 amino acid sequence
FTFDTYAMN

SEQ ID NO: 2596 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2597 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2598 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2599 - protein, 16 aa, Artificial Sequence
  Description of Artificial Sequence: Synthetic Heavy chain variable region CDR H3 amino acid sequence
VRHGNFGNSYVSWFAH

SEQ ID NO: 2600 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2601 - DNA, 327 bp, Artificial Sequence; identical to SEQ ID NO: 2425
  Description of Artificial Sequence: Synthetic Light chain variable region nucleic acid sequence

SEQ ID NO: 2602 - protein, 109 aa, Artificial Sequence; identical to SEQ ID NO: 2426
  Description of Artificial Sequence: Synthetic Light chain variable region amino acid sequence

SEQ ID NO: 2603 - protein, 14 aa, Artificial Sequence
  Description of Artificial Sequence: Synthetic Light chain variable region CDR L1 amino acid sequence
GSSTGAVTTSNYAN

SEQ ID NO: 2604 - DNA, 42 bp, Artificial Sequence; identical to SEQ ID NO: 204
  Description of Artificial Sequence: Synthetic Light chain variable region CDR L1 nucleic acid sequence

SEQ ID NO: 2605 - protein, 7 aa, Artificial Sequence
  Description of Artificial Sequence: Synthetic Light chain variable region CDR L2 amino acid sequence
GTDKRAP

SEQ ID NO: 2606 - DNA, 21 bp, Artificial Sequence
  Description of Artificial Sequence: Synthetic Light chain variable region CDR L2 nucleic acid sequence
ggcacagacaagcgcgctcct

SEQ ID NO: 2607 - protein, 9 aa, Artificial Sequence
  Description of Artificial Sequence: Synthetic Light chain variable region CDR L3 amino acid sequence
VLWYSNHWV

SEQ ID NO: 2608 - DNA, 27 bp, Artificial Sequence
  Description of Artificial Sequence: Synthetic Light chain variable region CDR L3 nucleic acid sequence
gtgctgtggtacagtaaccattgggtg

SEQ ID NO: 2609 - DNA, 375 bp, Artificial Sequence; identical to SEQ ID NO: 65
  Description of Artificial Sequence: Synthetic Heavy chain variable region nucleic acid sequence

SEQ ID NO: 2610 - protein, 125 aa, Artificial Sequence; identical to SEQ ID NO: 66
  Description of Artificial Sequence: Synthetic Heavy chain variable region amino acid sequence

SEQ ID NO: 2611 - protein, 9 aa, Artificial Sequence
  Description of Artificial Sequence: Synthetic Heavy chain variable region CDR H1 amino acid sequence
FTFDTYAMN

SEQ ID NO: 2612 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2613 - protein, 19 aa, Artificial Sequence
  Description of Artificial Sequence: Synthetic Heavy chain variable region CDR H2 amino acid sequence
RIRSKYNNYATYYADSVKG

SEQ ID NO: 2614 - DNA, 57 bp, Artificial Sequence; identical to SEQ ID NO: 70
  Description of Artificial Sequence: Synthetic Heavy chain variable region CDR H2 nucleic acid sequence

SEQ ID NO: 2615 - protein, 16 aa, Artificial Sequence
  Description of Artificial Sequence: Synthetic Heavy chain variable region CDR H3 amino acid sequence
VRHGNFGNSYVSWFAH

SEQ ID NO: 2616 - DNA, 48 bp, Artificial Sequence; identical to SEQ ID NO: 72
  Description of Artificial Sequence: Synthetic Heavy chain variable region CDR H3 nucleic acid sequence

SEQ ID NO: 2617 - DNA, 327 bp, Artificial Sequence; identical to SEQ ID NO: 2281
  Description of Artificial Sequence: Synthetic Light chain variable region nucleic acid sequence

SEQ ID NO: 2618 - protein, 109 aa, Artificial Sequence; identical to SEQ ID NO: 2282
  Description of Artificial Sequence: Synthetic Light chain variable region amino acid sequence

SEQ ID NO: 2619 - protein, 14 aa, Artificial Sequence
  Description of Artificial Sequence: Synthetic Light chain variable region CDR L1 amino acid sequence
GSSTGAVTTSNYAN

SEQ ID NO: 2620 - DNA, 42 bp, Artificial Sequence; identical to SEQ ID NO: 204
  Description of Artificial Sequence: Synthetic Light chain variable region CDR L1 nucleic acid sequence

SEQ ID NO: 2621 - protein, 7 aa, Artificial Sequence
  Description of Artificial Sequence: Synthetic Light chain variable region CDR L2 amino acid sequence
GTDKRAP

SEQ ID NO: 2622 - DNA, 21 bp, Artificial Sequence
  Description of Artificial Sequence: Synthetic Light chain variable region CDR L2 nucleic acid sequence
ggcacagacaagcgcgctcct

SEQ ID NO: 2623 - protein, 9 aa, Artificial Sequence
  Description of Artificial Sequence: Synthetic Light chain variable region CDR L3 amino acid sequence
ALWYSNHWV

SEQ ID NO: 2624 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 2625 - DNA, 375 bp, Artificial Sequence; identical to SEQ ID NO: 145
  Description of Artificial Sequence: Synthetic Heavy chain variable region nucleic acid sequence

SEQ ID NO: 2626 - protein, 125 aa, Artificial Sequence; identical to SEQ ID NO: 146
  Description of Artificial Sequence: Synthetic Heavy chain variable region amino acid sequence

SEQ ID NO: 2627 - protein, 9 aa, Artificial Sequence
  Description of Artificial Sequence: Synthetic Heavy chain variable region CDR H1 amino acid sequence
FTFDTYAMN

SEQ ID NO: 2628 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2629 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2630 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2631 - protein, 16 aa, Artificial Sequence
  Description of Artificial Sequence: Synthetic Heavy chain variable region CDR H3 amino acid sequence
VRHSNFGNSYVSWFAH

SEQ ID NO: 2632 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2633 - DNA, 327 bp, Artificial Sequence; identical to SEQ ID NO: 2297
  Description of Artificial Sequence: Synthetic Light chain variable region nucleic acid sequence

SEQ ID NO: 2634 - protein, 109 aa, Artificial Sequence; identical to SEQ ID NO: 2298
  Description of Artificial Sequence: Synthetic Light chain variable region amino acid sequence

SEQ ID NO: 2635 - protein, 14 aa, Artificial Sequence
  Description of Artificial Sequence: Synthetic Light chain variable region CDR L1 amino acid sequence
GSSTGAVTTSNYAN

SEQ ID NO: 2636 - DNA, 42 bp, Artificial Sequence; identical to SEQ ID NO: 204
  Description of Artificial Sequence: Synthetic Light chain variable region CDR L1 nucleic acid sequence

SEQ ID NO: 2637 - protein, 7 aa, Artificial Sequence
  Description of Artificial Sequence: Synthetic Light chain variable region CDR L2 amino acid sequence
GTDKRAP

SEQ ID NO: 2638 - DNA, 21 bp, Artificial Sequence
  Description of Artificial Sequence: Synthetic Light chain variable region CDR L2 nucleic acid sequence
ggcacagacaagcgcgctcct

SEQ ID NO: 2639 - protein, 9 aa, Artificial Sequence
  Description of Artificial Sequence: Synthetic Light chain variable region CDR L3 amino acid sequence
ALWYSNLWV

SEQ ID NO: 2640 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2641 - DNA, 375 bp, Artificial Sequence; identical to SEQ ID NO: 145
  Description of Artificial Sequence: Synthetic Heavy chain variable region nucleic acid sequence

SEQ ID NO: 2642 - protein, 125 aa, Artificial Sequence; identical to SEQ ID NO: 146
  Description of Artificial Sequence: Synthetic Heavy chain variable region amino acid sequence

SEQ ID NO: 2643 - protein, 9 aa, Artificial Sequence
  Description of Artificial Sequence: Synthetic Heavy chain variable region CDR H1 amino acid sequence
FTFDTYAMN

SEQ ID NO: 2644 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2645 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2646 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2647 - protein, 16 aa, Artificial Sequence
  Description of Artificial Sequence: Synthetic Heavy chain variable region CDR H3 amino acid sequence
VRHSNFGNSYVSWFAH

SEQ ID NO: 2648 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2649 - DNA, 327 bp, Artificial Sequence; identical to SEQ ID NO: 2313
  Description of Artificial Sequence: Synthetic Light chain variable region nucleic acid sequence

SEQ ID NO: 2650 - protein, 109 aa, Artificial Sequence; identical to SEQ ID NO: 2314
  Description of Artificial Sequence: Synthetic Light chain variable region amino acid sequence

SEQ ID NO: 2651 - protein, 14 aa, Artificial Sequence
  Description of Artificial Sequence: Synthetic Light chain variable region CDR L1 amino acid sequence
GSSTGAVTTSNYAN

SEQ ID NO: 2652 - DNA, 42 bp, Artificial Sequence; identical to SEQ ID NO: 204
  Description of Artificial Sequence: Synthetic Light chain variable region CDR L1 nucleic acid sequence

SEQ ID NO: 2653 - protein, 7 aa, Artificial Sequence
  Description of Artificial Sequence: Synthetic Light chain variable region CDR L2 amino acid sequence
GTDKRAP

SEQ ID NO: 2654 - DNA, 21 bp, Artificial Sequence
  Description of Artificial Sequence: Synthetic Light chain variable region CDR L2 nucleic acid sequence
ggcacagacaagcgcgctcct

SEQ ID NO: 2655 - protein, 9 aa, Artificial Sequence
  Description of Artificial Sequence: Synthetic Light chain variable region CDR L3 amino acid sequence
ALWYNNLWV

SEQ ID NO: 2656 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 2657 - DNA, 375 bp, Artificial Sequence; identical to SEQ ID NO: 145
  Description of Artificial Sequence: Synthetic Heavy chain variable region nucleic acid sequence

SEQ ID NO: 2658 - protein, 125 aa, Artificial Sequence; identical to SEQ ID NO: 146
  Description of Artificial Sequence: Synthetic Heavy chain variable region amino acid sequence

SEQ ID NO: 2659 - protein, 9 aa, Artificial Sequence
  Description of Artificial Sequence: Synthetic Heavy chain variable region CDR H1 amino acid sequence
FTFDTYAMN

SEQ ID NO: 2660 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2661 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2662 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2663 - protein, 16 aa, Artificial Sequence
  Description of Artificial Sequence: Synthetic Heavy chain variable region CDR H3 amino acid sequence
VRHSNFGNSYVSWFAH

SEQ ID NO: 2664 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2665 - DNA, 327 bp, Artificial Sequence; identical to SEQ ID NO: 2505
  Description of Artificial Sequence: Synthetic Light chain variable region nucleic acid sequence

SEQ ID NO: 2666 - protein, 109 aa, Artificial Sequence; identical to SEQ ID NO: 2506
  Description of Artificial Sequence: Synthetic Light chain variable region amino acid sequence

SEQ ID NO: 2667 - protein, 14 aa, Artificial Sequence
  Description of Artificial Sequence: Synthetic Light chain variable region CDR L1 amino acid sequence
GSSAGAVTTSNYAN

SEQ ID NO: 2668 - DNA, 42 bp, Artificial Sequence; identical to SEQ ID NO: 236
  Description of Artificial Sequence: Synthetic Light chain variable region CDR L1 nucleic acid sequence

SEQ ID NO: 2669 - protein, 7 aa, Artificial Sequence
  Description of Artificial Sequence: Synthetic Light chain variable region CDR L2 amino acid sequence
GTDKRAP

SEQ ID NO: 2670 - DNA, 21 bp, Artificial Sequence
  Description of Artificial Sequence: Synthetic Light chain variable region CDR L2 nucleic acid sequence
ggcacagacaagcgcgctcct

SEQ ID NO: 2671 - protein, 9 aa, Artificial Sequence
  Description of Artificial Sequence: Synthetic Light chain variable region CDR L3 amino acid sequence
ALWYSNLWV

SEQ ID NO: 2672 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2673 - DNA, 375 bp, Artificial Sequence; identical to SEQ ID NO: 145
  Description of Artificial Sequence: Synthetic Heavy chain variable region nucleic acid sequence

SEQ ID NO: 2674 - protein, 125 aa, Artificial Sequence; identical to SEQ ID NO: 146
  Description of Artificial Sequence: Synthetic Heavy chain variable region amino acid sequence

SEQ ID NO: 2675 - protein, 9 aa, Artificial Sequence
  Description of Artificial Sequence: Synthetic Heavy chain variable region CDR H1 amino acid sequence
FTFDTYAMN

SEQ ID NO: 2676 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2677 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2678 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2679 - protein, 16 aa, Artificial Sequence
  Description of Artificial Sequence: Synthetic Heavy chain variable region CDR H3 amino acid sequence
VRHSNFGNSYVSWFAH

SEQ ID NO: 2680 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2681 - DNA, 327 bp, Artificial Sequence; identical to SEQ ID NO: 1257
  Description of Artificial Sequence: Synthetic Light chain variable region nucleic acid sequence

SEQ ID NO: 2682 - protein, 109 aa, Artificial Sequence; identical to SEQ ID NO: 1258
  Description of Artificial Sequence: Synthetic Light chain variable region amino acid sequence

SEQ ID NO: 2683 - protein, 14 aa, Artificial Sequence
  Description of Artificial Sequence: Synthetic Light chain variable region CDR L1 amino acid sequence
GSSTGAVTTSNYAN

SEQ ID NO: 2684 - DNA, 42 bp, Artificial Sequence; identical to SEQ ID NO: 204
  Description of Artificial Sequence: Synthetic Light chain variable region CDR L1 nucleic acid sequence

SEQ ID NO: 2685 - protein, 7 aa, Artificial Sequence
  Description of Artificial Sequence: Synthetic Light chain variable region CDR L2 amino acid sequence
GTDKRAP

SEQ ID NO: 2686 - DNA, 21 bp, Artificial Sequence
  Description of Artificial Sequence: Synthetic Light chain variable region CDR L2 nucleic acid sequence
ggcacagacaagcgcgctcct

SEQ ID NO: 2687 - protein, 9 aa, Artificial Sequence
  Description of Artificial Sequence: Synthetic Light chain variable region CDR L3 amino acid sequence
ALWYSNLWV

SEQ ID NO: 2688 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 2689 - DNA, 375 bp, Artificial Sequence; identical to SEQ ID NO: 145
  Description of Artificial Sequence: Synthetic Heavy chain variable region nucleic acid sequence

SEQ ID NO: 2690 - protein, 125 aa, Artificial Sequence; identical to SEQ ID NO: 146
  Description of Artificial Sequence: Synthetic Heavy chain variable region amino acid sequence

SEQ ID NO: 2691 - protein, 9 aa, Artificial Sequence
  Description of Artificial Sequence: Synthetic Heavy chain variable region CDR H1 amino acid sequence
FTFDTYAMN

SEQ ID NO: 2692 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2693 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2694 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2695 - protein, 16 aa, Artificial Sequence
  Description of Artificial Sequence: Synthetic Heavy chain variable region CDR H3 amino acid sequence
VRHSNFGNSYVSWFAH

SEQ ID NO: 2696 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2697 - DNA, 327 bp, Artificial Sequence; identical to SEQ ID NO: 2409
  Description of Artificial Sequence: Synthetic Light chain variable region nucleic acid sequence

SEQ ID NO: 2698 - protein, 109 aa, Artificial Sequence; identical to SEQ ID NO: 2410
  Description of Artificial Sequence: Synthetic Light chain variable region amino acid sequence

SEQ ID NO: 2699 - protein, 14 aa, Artificial Sequence
  Description of Artificial Sequence: Synthetic Light chain variable region CDR L1 amino acid sequence
GSSTGAVTTSNYAN

SEQ ID NO: 2700 - DNA, 42 bp, Artificial Sequence; identical to SEQ ID NO: 204
  Description of Artificial Sequence: Synthetic Light chain variable region CDR L1 nucleic acid sequence

SEQ ID NO: 2701 - protein, 7 aa, Artificial Sequence
  Description of Artificial Sequence: Synthetic Light chain variable region CDR L2 amino acid sequence
GTDKRAP

SEQ ID NO: 2702 - DNA, 21 bp, Artificial Sequence
  Description of Artificial Sequence: Synthetic Light chain variable region CDR L2 nucleic acid sequence
ggcacagacaagcgcgctcct

SEQ ID NO: 2703 - protein, 9 aa, Artificial Sequence
  Description of Artificial Sequence: Synthetic Light chain variable region CDR L3 amino acid sequence
ALWYNNLWV

SEQ ID NO: 2704 - DNA, 27 bp, Artificial Sequence
  Description of Artificial Sequence: Synthetic Light chain variable region CDR L3 nucleic acid sequence
gcgctgtggtacaataacctttgggtg

SEQ ID NO: 2705 - DNA, 375 bp, Artificial Sequence; identical to SEQ ID NO: 145
  Description of Artificial Sequence: Synthetic Heavy chain variable region nucleic acid sequence

SEQ ID NO: 2706 - protein, 125 aa, Artificial Sequence; identical to SEQ ID NO: 146
  Description of Artificial Sequence: Synthetic Heavy chain variable region amino acid sequence

SEQ ID NO: 2707 - protein, 9 aa, Artificial Sequence
  Description of Artificial Sequence: Synthetic Heavy chain variable region CDR H1 amino acid sequence
FTFDTYAMN

SEQ ID NO: 2708 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2709 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2710 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2711 - protein, 16 aa, Artificial Sequence
  Description of Artificial Sequence: Synthetic Heavy chain variable region CDR H3 amino acid sequence
VRHSNFGNSYVSWFAH

SEQ ID NO: 2712 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2713 - DNA, 327 bp, Artificial Sequence; identical to SEQ ID NO: 329
  Description of Artificial Sequence: Synthetic Light chain variable region nucleic acid sequence

SEQ ID NO: 2714 - protein, 109 aa, Artificial Sequence; identical to SEQ ID NO: 330
  Description of Artificial Sequence: Synthetic Light chain variable region amino acid sequence

SEQ ID NO: 2715 - protein, 14 aa, Artificial Sequence
  Description of Artificial Sequence: Synthetic Light chain variable region CDR L1 amino acid sequence
GSSTGAVTTSNYAN

SEQ ID NO: 2716 - DNA, 42 bp, Artificial Sequence; identical to SEQ ID NO: 204
  Description of Artificial Sequence: Synthetic Light chain variable region CDR L1 nucleic acid sequence

SEQ ID NO: 2717 - protein, 7 aa, Artificial Sequence
  Description of Artificial Sequence: Synthetic Light chain variable region CDR L2 amino acid sequence
GTDKRAP

SEQ ID NO: 2718 - DNA, 21 bp, Artificial Sequence
  Description of Artificial Sequence: Synthetic Light chain variable region CDR L2 nucleic acid sequence
ggcacagacaagcgcgctcct

SEQ ID NO: 2719 - protein, 9 aa, Artificial Sequence
  Description of Artificial Sequence: Synthetic Light chain variable region CDR L3 amino acid sequence
VLWYSNLWV

SEQ ID NO: 2720 - DNA, 27 bp, Artificial Sequence
  Description of Artificial Sequence: Synthetic Light chain variable region CDR L3 nucleic acid sequence
gtgctgtggtacagtaacctttgggtg

SEQ ID NO: 2721 - DNA, 375 bp, Artificial Sequence; identical to SEQ ID NO: 145
  Description of Artificial Sequence: Synthetic Heavy chain variable region nucleic acid sequence

SEQ ID NO: 2722 - protein, 125 aa, Artificial Sequence; identical to SEQ ID NO: 146
  Description of Artificial Sequence: Synthetic Heavy chain variable region amino acid sequence

SEQ ID NO: 2723 - protein, 9 aa, Artificial Sequence
  Description of Artificial Sequence: Synthetic Heavy chain variable region CDR H1 amino acid sequence
FTFDTYAMN

SEQ ID NO: 2724 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2725 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2726 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2727 - protein, 16 aa, Artificial Sequence
  Description of Artificial Sequence: Synthetic Heavy chain variable region CDR H3 amino acid sequence
VRHSNFGNSYVSWFAH

SEQ ID NO: 2728 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2729 - DNA, 327 bp, Artificial Sequence; identical to SEQ ID NO: 345
  Description of Artificial Sequence: Synthetic Light chain variable region nucleic acid sequence

SEQ ID NO: 2730 - protein, 109 aa, Artificial Sequence; identical to SEQ ID NO: 346
  Description of Artificial Sequence: Synthetic Light chain variable region amino acid sequence

SEQ ID NO: 2731 - protein, 14 aa, Artificial Sequence
  Description of Artificial Sequence: Synthetic Light chain variable region CDR L1 amino acid sequence
GSSTGAVTTSNYAN

SEQ ID NO: 2732 - DNA, 42 bp, Artificial Sequence; identical to SEQ ID NO: 204
  Description of Artificial Sequence: Synthetic Light chain variable region CDR L1 nucleic acid sequence

SEQ ID NO: 2733 - protein, 7 aa, Artificial Sequence
  Description of Artificial Sequence: Synthetic Light chain variable region CDR L2 amino acid sequence
GTDKRAP

SEQ ID NO: 2734 - DNA, 21 bp, Artificial Sequence
  Description of Artificial Sequence: Synthetic Light chain variable region CDR L2 nucleic acid sequence
ggcacagacaagcgcgctcct

SEQ ID NO: 2735 - protein, 9 aa, Artificial Sequence
  Description of Artificial Sequence: Synthetic Light chain variable region CDR L3 amino acid sequence
ALWYSNHWV

SEQ ID NO: 2736 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 2737 - DNA, 375 bp, Artificial Sequence; identical to SEQ ID NO: 145
  Description of Artificial Sequence: Synthetic Heavy chain variable region nucleic acid sequence

SEQ ID NO: 2738 - protein, 125 aa, Artificial Sequence; identical to SEQ ID NO: 146
  Description of Artificial Sequence: Synthetic Heavy chain variable region amino acid sequence

SEQ ID NO: 2739 - protein, 9 aa, Artificial Sequence
  Description of Artificial Sequence: Synthetic Heavy chain variable region CDR H1 amino acid sequence
FTFDTYAMN

SEQ ID NO: 2740 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 2741 - protein, 19 aa, Artificial Sequence
  Description of Artificial Sequence: Synthetic Heavy chain variable region CDR H2 amino acid sequence
RIRSKYNNYATYYADSVKD

SEQ ID NO: 2742 - DNA, 57 bp, Artificial Sequence; identical to SEQ ID NO: 6
  Description of Artificial Sequence: Synthetic Heavy chain variable region CDR H2 nucleic acid sequence

SEQ ID NO: 2743 - protein, 16 aa, Artificial Sequence
  Description of Artificial Sequence: Synthetic Heavy chain variable region CDR H3 amino acid sequence
VRHSNFGNSYVSWFAH

SEQ ID NO: 2744 - DNA, 48 bp, Artificial Sequence; identical to SEQ ID NO: 152
  Description of Artificial Sequence: Synthetic Heavy chain variable region CDR H3 nucleic acid sequence

SEQ ID NO: 2745 - DNA, 327 bp, Artificial Sequence; identical to SEQ ID NO: 2425
  Description of Artificial Sequence: Synthetic Light chain variable region nucleic acid sequence

SEQ ID NO: 2746 - protein, 109 aa, Artificial Sequence; identical to SEQ ID NO: 2426
  Description of Artificial Sequence: Synthetic Light chain variable region amino acid sequence

SEQ ID NO: 2747 - protein, 14 aa, Artificial Sequence
  Description of Artificial Sequence: Synthetic Light chain variable region CDR L1 amino acid sequence
GSSTGAVTTSNYAN

SEQ ID NO: 2748 - DNA, 42 bp, Artificial Sequence; identical to SEQ ID NO: 204
  Description of Artificial Sequence: Synthetic Light chain variable region CDR L1 nucleic acid sequence

SEQ ID NO: 2749 - protein, 7 aa, Artificial Sequence
  Description of Artificial Sequence: Synthetic Light chain variable region CDR L2 amino acid sequence
GTDKRAP

SEQ ID NO: 2750 - DNA, 21 bp, Artificial Sequence
  Description of Artificial Sequence: Synthetic Light chain variable region CDR L2 nucleic acid sequence
ggcacagacaagcgcgctcct

SEQ ID NO: 2751 - protein, 9 aa, Artificial Sequence
  Description of Artificial Sequence: Synthetic Light chain variable region CDR L3 amino acid sequence
VLWYSNHWV

SEQ ID NO: 2752 - DNA, 27 bp, Artificial Sequence
  Description of Artificial Sequence: Synthetic Light chain variable region CDR L3 nucleic acid sequence
gtgctgtggtacagtaaccattgggtg

SEQ ID NO: 2753 - DNA, 351 bp, Artificial Sequence
  Description of Artificial Sequence: Synthetic Heavy chain variable region nucleic acid sequence
caggtacagctgcagcagtcaggacctgagctggtgaagcctggggcttcagtgaggatatcctgcaaggcttctggctacaccttcataagctactatatacactgggtgaagcagaggcctggacagggacttgagtggattggatggatttatcctggaaatgttaatactaagtacaatgagaagttcaaggccaaggccacactgactgcagacaaatcctccagcacagcctacatgcagctcagcagtctgacctctgaggactctgcggtctatttctgtgcaagagatgataactactcctttgcttactggggccaaggcaaccacggtcaccgtctcctc

SEQ ID NO: 2754 - protein, 117 aa, Artificial Sequence
  Description of Artificial Sequence: Synthetic Heavy chain variable region amino acid sequence
QVQLQQSGPELVKPGASVRISCKASGYTFISYYIHWVKQRPGQGLEWIGWIYPGNVNTKYNEKFKAKATLTADKSSSTAYMQLSSLTSEDSAVYFCARDDNYSFAYWGQGNHGHRLL

SEQ ID NO: 2755 - protein, 9 aa, Artificial Sequence
  Description of Artificial Sequence: Synthetic Heavy chain variable region CDR H1 amino acid sequence
YTFISYYIH

SEQ ID NO: 2756 - DNA, 27 bp, Artificial Sequence
  Description of Artificial Sequence: Synthetic Heavy chain variable region CDR H1 nucleic acid sequence
tacaccttcataagctactatatacac

SEQ ID NO: 2757 - protein, 17 aa, Artificial Sequence
  Description of Artificial Sequence: Synthetic Heavy chain variable region CDR H2 amino acid sequence
WIYPGNVNTKYNEKFKA

SEQ ID NO: 2758 - DNA, 51 bp, Artificial Sequence
  Description of Artificial Sequence: Synthetic Heavy chain variable region CDR H2 nucleic acid sequence
tggatttatcctggaaatgttaatactaagtacaatgagaagttcaaggcc

SEQ ID NO: 2759 - protein, 10 aa, Artificial Sequence
  Description of Artificial Sequence: Synthetic Heavy chain variable region CDR H3 amino acid sequence
ARDDNYSFAY

SEQ ID NO: 2760 - DNA, 30 bp, Artificial Sequence
  Description of Artificial Sequence: Synthetic Heavy chain variable region CDR H3 nucleic acid sequence
gcaagagatgataactactcctttgcttac

SEQ ID NO: 2761 - DNA, 336 bp, Artificial Sequence
  Description of Artificial Sequence: Synthetic Light chain variable region nucleic acid sequence
gacatcgtgatgatccagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggagggaccaagctggaaataaaa

SEQ ID NO: 2762 - protein, 112 aa, Artificial Sequence
  Description of Artificial Sequence: Synthetic Light chain variable region amino acid sequence
DIVMIQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLRTFGGGTKLEIK

SEQ ID NO: 2763 - protein, 17 aa, Artificial Sequence
  Description of Artificial Sequence: Synthetic Light chain variable region CDR L1 amino acid sequence
KSSQSLLNSRTRKNYLA

SEQ ID NO: 2764 - DNA, 51 bp, Artificial Sequence
  Description of Artificial Sequence: Synthetic Light chain variable region CDR L1 nucleic acid sequence
aaatccagtcagagtctgctcaacagtagaacccgaaagaactacttggct

SEQ ID NO: 2765 - protein, 7 aa, Artificial Sequence
  Description of Artificial Sequence: Synthetic Light chain variable region CDR L2 amino acid sequence
WASTRES

SEQ ID NO: 2766 - DNA, 21 bp, Artificial Sequence
  Description of Artificial Sequence: Synthetic Light chain variable region CDR L2 nucleic acid sequence
tgggcatccactagggaatct

SEQ ID NO: 2767 - protein, 8 aa, Artificial Sequence
  Description of Artificial Sequence: Synthetic Light chain variable region CDR L3 amino acid sequence
KQSYNLRT

SEQ ID NO: 2768 - DNA, 24 bp, Artificial Sequence
  Description of Artificial Sequence: Synthetic Light chain variable region CDR L3 nucleic acid sequence
aagcaatcttataatcttcggacg

SEQ ID NO: 2769 - DNA, 351 bp, Artificial Sequence
  Description of Artificial Sequence: Synthetic Heavy chain variable region nucleic acid sequence
gaagtacagctgcagcagtctggacctgacctggtgaagcctggggcttcagtgaagatgtcctgcaaggcttctggctacgccttcacaagctactatatacactgggtgaagcagaggcctggacagggacttgagtggattggatggatttatcttggagatggtagtactaactacaatgagaagttcaagggcaagaccacactgactgcagacaaatcctccagcacagcctacatgttgctcagcagcctgacctctgaggactctgcgacctatttctgtgcaagggatgattcgtactactttgactactggggccaaggcaccacggtcaccgtctcctca

SEQ ID NO: 2770 - protein, 117 aa, Artificial Sequence
  Description of Artificial Sequence: Synthetic Heavy chain variable region amino acid sequence
EVQLQQSGPDLVKPGASVKMSCKASGYAFTSYYIHWVKQRPGQGLEWIGWIYLGDGSTNYNEKFKGKTTLTADKSSSTAYMLLSSLTSEDSATYFCARDDSYYFDYWGQGTTVTVSS

SEQ ID NO: 2771 - protein, 9 aa, Artificial Sequence
  Description of Artificial Sequence: Synthetic Heavy chain variable region CDR H1 amino acid sequence
YAFTSYYIH

SEQ ID NO: 2772 - DNA, 27 bp, Artificial Sequence
  Description of Artificial Sequence: Synthetic Heavy chain variable region CDR H1 nucleic acid sequence
tacgccttcacaagctactatatacac

SEQ ID NO: 2773 - protein, 17 aa, Artificial Sequence
  Description of Artificial Sequence: Synthetic Heavy chain variable region CDR H2 amino acid sequence
WIYLGDGSTNYNEKFKG

SEQ ID NO: 2774 - DNA, 51 bp, Artificial Sequence
  Description of Artificial Sequence: Synthetic Heavy chain variable region CDR H2 nucleic acid sequence
tggatttatcttggagatggtagtactaactacaatgagaagttcaagggc

SEQ ID NO: 2775 - protein, 10 aa, Artificial Sequence
  Description of Artificial Sequence: Synthetic Heavy chain variable region CDR H3 amino acid sequence
ARDDSYYFDY

SEQ ID NO: 2776 - DNA, 30 bp, Artificial Sequence
  Description of Artificial Sequence: Synthetic Heavy chain variable region CDR H3 nucleic acid sequence
gcaagggatgattcgtactactttgactac

SEQ ID NO: 2777 - DNA, 336 bp, Artificial Sequence
  Description of Artificial Sequence: Synthetic Light chain variable region nucleic acid sequence
gacattcagctcactcagtctccatcctccctggctgtgtcagcaggagagaaggtcactatgagctgcaaatccagtcagagtctgctcaacagtagaacccgaaagaactacttggcttggtaccaacagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttatagtcttcggacgttcggtggagggaccaagctggaaatcaaa

SEQ ID NO: 2778 - protein, 112 aa, Artificial Sequence
  Description of Artificial Sequence: Synthetic Light chain variable region amino acid sequence
DIQLTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYSLRTFGGGTKLEIK

SEQ ID NO: 2779 - protein, 17 aa, Artificial Sequence
  Description of Artificial Sequence: Synthetic Light chain variable region CDR L1 amino acid sequence
KSSQSLLNSRTRKNYLA

SEQ ID NO: 2780 - DNA, 51 bp, Artificial Sequence; identical to SEQ ID NO: 2764
  Description of Artificial Sequence: Synthetic Light chain variable region CDR L1 nucleic acid sequence

SEQ ID NO: 2781 - protein, 7 aa, Artificial Sequence
  Description of Artificial Sequence: Synthetic Light chain variable region CDR L2 amino acid sequence
WASTRES

SEQ ID NO: 2782 - DNA, 21 bp, Artificial Sequence
  Description of Artificial Sequence: Synthetic Light chain variable region CDR L2 nucleic acid sequence
tgggcatccactagggaatct

SEQ ID NO: 2783 - protein, 8 aa, Artificial Sequence
  Description of Artificial Sequence: Synthetic Light chain variable region CDR L3 amino acid sequence
KQSYSLRT

SEQ ID NO: 2784 - DNA, 24 bp, Artificial Sequence
  Description of Artificial Sequence: Synthetic Light chain variable region CDR L3 nucleic acid sequence
aagcaatcttatagtcttcggacg

SEQ ID NO: 2785 - DNA, 351 bp, Artificial Sequence
  Description of Artificial Sequence: Synthetic Heavy chain variable region nucleic acid sequence
caggtgaagctggaggagtcaggacctgagctggtgaagcctggggcttcagtgaggatatcctgcaaggcttctggctacaccttcacacgctactatatacactgggtgaagcagaggcctggacagggacttgagtggattggatggatttatcctggaaatgttaatactaaatacaatgagaagttcaagggcaaggccacactgtctgcagacaaatcctccagcacagcctacatgcagctcagcagcctgacctctgaggactctgcggtctatttctgtgcaagagatggtgattactactttgactactggggccaaggcaccacggtcaccgtctcctca

SEQ ID NO: 2786 - protein, 117 aa, Artificial Sequence
  Description of Artificial Sequence: Synthetic Heavy chain variable region amino acid sequence
QVKLEESGPELVKPGASVRISCKASGYTFTRYYIHWVKQRPGQGLEWIGWIYPGNVNTKYNEKFKGKATLSADKSSSTAYMQLSSLTSEDSAVYFCARDGDYYFDYWGQGTTVTVSS

SEQ ID NO: 2787 - protein, 9 aa, Artificial Sequence
  Description of Artificial Sequence: Synthetic Heavy chain variable region CDR H1 amino acid sequence
YTFTRYYIH

SEQ ID NO: 2788 - DNA, 27 bp, Artificial Sequence
  Description of Artificial Sequence: Synthetic Heavy chain variable region CDR H1 nucleic acid sequence
tacaccttcacacgctactatatacac

SEQ ID NO: 2789 - protein, 17 aa, Artificial Sequence
  Description of Artificial Sequence: Synthetic Heavy chain variable region CDR H2 amino acid sequence
WIYPGNVNTKYNEKFKG

SEQ ID NO: 2790 - DNA, 51 bp, Artificial Sequence
  Description of Artificial Sequence: Synthetic Heavy chain variable region CDR H2 nucleic acid sequence
tggatttatcctggaaatgttaatactaaatacaatgagaagttcaagggc

SEQ ID NO: 2791 - protein, 10 aa, Artificial Sequence
  Description of Artificial Sequence: Synthetic Heavy chain variable region CDR H3 amino acid sequence
ARDGDYYFDY

SEQ ID NO: 2792 - DNA, 30 bp, Artificial Sequence
  Description of Artificial Sequence: Synthetic Heavy chain variable region CDR H3 nucleic acid sequence
gcaagagatggtgattactactttgactac

SEQ ID NO: 2793 - DNA, 336 bp, Artificial Sequence
  Description of Artificial Sequence: Synthetic Light chain variable region nucleic acid sequence
gacattcagctcactcagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggaggcaccaagctggaaatcaaa

SEQ ID NO: 2794 - protein, 112 aa, Artificial Sequence
  Description of Artificial Sequence: Synthetic Light chain variable region amino acid sequence
DIQLTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLRTFGGGTKLEIK

SEQ ID NO: 2795 - protein, 17 aa, Artificial Sequence
  Description of Artificial Sequence: Synthetic Light chain variable region CDR L1 amino acid sequence
KSSQSLLNSRTRKNYLA

SEQ ID NO: 2796 - DNA, 51 bp, Artificial Sequence; identical to SEQ ID NO: 2764
  Description of Artificial Sequence: Synthetic Light chain variable region CDR L1 nucleic acid sequence

SEQ ID NO: 2797 - protein, 7 aa, Artificial Sequence
  Description of Artificial Sequence: Synthetic Light chain variable region CDR L2 amino acid sequence
WASTRES

SEQ ID NO: 2798 - DNA, 21 bp, Artificial Sequence
  Description of Artificial Sequence: Synthetic Light chain variable region CDR L2 nucleic acid sequence
tgggcatccactagggaatct

SEQ ID NO: 2799 - protein, 8 aa, Artificial Sequence
  Description of Artificial Sequence: Synthetic Light chain variable region CDR L3 amino acid sequence
KQSYNLRT

SEQ ID NO: 2800 - DNA, 24 bp, Artificial Sequence
  Description of Artificial Sequence: Synthetic Light chain variable region CDR L3 nucleic acid sequence
aagcaatcttataatcttcggacg

SEQ ID NO: 2801 - DNA, 351 bp, Artificial Sequence
  Description of Artificial Sequence: Synthetic Heavy chain variable region nucleic acid sequence
gaggtgcagctgcaggagtctggacctgagctggtgaaacctggggcttcagtgaggatatcctgcaaggcttctggctacaccttcacaagctactatatacactgggtgaagcagaggcctggacagggacttgagtggattggatggatttatcctggaaatgttaatactaagtacaatgagaagttcaagggcaaggccacactgactgcagacaaatcctccagcacagcctacatgcagctcagcagcctgacctctgaggactctgcggtctatttctgtgcaagagatggtgattactactttgactactggggccaaggcaccacggtcaccgtctcctca

SEQ ID NO: 2802 - protein, 117 aa, Artificial Sequence
  Description of Artificial Sequence: Synthetic Heavy chain variable region amino acid sequence
EVQLQESGPELVKPGASVRISCKASGYTFTSYYIHWVKQRPGQGLEWIGWIYPGNVNTKYNEKFKGKATLTADKSSSTAYMQLSSLTSEDSAVYFCARDGDYYFDYWGQGTTVTVSS

SEQ ID NO: 2803 - protein, 9 aa, Artificial Sequence
  Description of Artificial Sequence: Synthetic Heavy chain variable region CDR H1 amino acid sequence
YTFTSYYIH

SEQ ID NO: 2804 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 2805 - protein, 17 aa, Artificial Sequence
  Description of Artificial Sequence: Synthetic Heavy chain variable region CDR H2 amino acid sequence
WIYPGNVNTKYNEKFKG

SEQ ID NO: 2806 - DNA, 51 bp, Artificial Sequence
  Description of Artificial Sequence: Synthetic Heavy chain variable region CDR H2 nucleic acid sequence
tggatttatcctggaaatgttaatactaagtacaatgagaagttcaagggc

SEQ ID NO: 2807 - protein, 10 aa, Artificial Sequence
  Description of Artificial Sequence: Synthetic Heavy chain variable region CDR H3 amino acid sequence
ARDGDYYFDY

SEQ ID NO: 2808 - DNA, 30 bp, Artificial Sequence; identical to SEQ ID NO: 2792
  Description of Artificial Sequence: Synthetic Heavy chain variable region CDR H3 nucleic acid sequence

SEQ ID NO: 2809 - DNA, 336 bp, Artificial Sequence
  Description of Artificial Sequence: Synthetic Light chain variable region nucleic acid sequence
gacattcagctgacccagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggagggaccaagctggagctgaaa

SEQ ID NO: 2810 - protein, 112 aa, Artificial Sequence
  Description of Artificial Sequence: Synthetic Light chain variable region amino acid sequence
DIQLTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLRTFGGGTKLELK

SEQ ID NO: 2811 - protein, 17 aa, Artificial Sequence
  Description of Artificial Sequence: Synthetic Light chain variable region CDR L1 amino acid sequence
KSSQSLLNSRTRKNYLA

SEQ ID NO: 2812 - DNA, 51 bp, Artificial Sequence; identical to SEQ ID NO: 2764
  Description of Artificial Sequence: Synthetic Light chain variable region CDR L1 nucleic acid sequence

SEQ ID NO: 2813 - protein, 7 aa, Artificial Sequence
  Description of Artificial Sequence: Synthetic Light chain variable region CDR L2 amino acid sequence
WASTRES

SEQ ID NO: 2814 - DNA, 21 bp, Artificial Sequence
  Description of Artificial Sequence: Synthetic Light chain variable region CDR L2 nucleic acid sequence
tgggcatccactagggaatct

SEQ ID NO: 2815 - protein, 8 aa, Artificial Sequence
  Description of Artificial Sequence: Synthetic Light chain variable region CDR L3 amino acid sequence
KQSYNLRT

SEQ ID NO: 2816 - DNA, 24 bp, Artificial Sequence
  Description of Artificial Sequence: Synthetic Light chain variable region CDR L3 nucleic acid sequence
aagcaatcttataatcttcggacg

SEQ ID NO: 2817 - DNA, 351 bp, Artificial Sequence
  Description of Artificial Sequence: Synthetic Heavy chain variable region nucleic acid sequence
gaggtcaagctggaggagtcaggacctgagctggcgaagcctggggcttcagtgaggatatcctgcaaggcttctggctacaccttcacaagctactatatacactgggtgaagcagaggcctggacagggacttgagtggattggatggatttatcctggaaatgttaatactaagtacaatgagaagttcaagggcaaggccacactgactgcagacacatcctccagcacagcctacatgcagctcagcagcctgacctctgaggactctgcggtctatttctgtgcaagagatggtaactacttcttcgatgtctggggccaaggcaccacggtcaccgtctcctca

SEQ ID NO: 2818 - protein, 117 aa, Artificial Sequence
  Description of Artificial Sequence: Synthetic Heavy chain variable region amino acid sequence
EVKLEESGPELAKPGASVRISCKASGYTFTSYYIHWVKQRPGQGLEWIGWIYPGNVNTKYNEKFKGKATLTADTSSSTAYMQLSSLTSEDSAVYFCARDGNYFFDVWGQGTTVTVSS

SEQ ID NO: 2819 - protein, 9 aa, Artificial Sequence
  Description of Artificial Sequence: Synthetic Heavy chain variable region CDR H1 amino acid sequence
YTFTSYYIH

SEQ ID NO: 2820 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 2821 - protein, 17 aa, Artificial Sequence
  Description of Artificial Sequence: Synthetic Heavy chain variable region CDR H2 amino acid sequence
WIYPGNVNTKYNEKFKG

SEQ ID NO: 2822 - DNA, 51 bp, Artificial Sequence; identical to SEQ ID NO: 2806
  Description of Artificial Sequence: Synthetic Heavy chain variable region CDR H2 nucleic acid sequence

SEQ ID NO: 2823 - protein, 10 aa, Artificial Sequence
  Description of Artificial Sequence: Synthetic Heavy chain variable region CDR H3 amino acid sequence
ARDGNYFFDV

SEQ ID NO: 2824 - DNA, 30 bp, Artificial Sequence
  Description of Artificial Sequence: Synthetic Heavy chain variable region CDR H3 nucleic acid sequence
gcaagagatggtaactacttcttcgatgtc

SEQ ID NO: 2825 - DNA, 336 bp, Artificial Sequence
  Description of Artificial Sequence: Synthetic Light chain variable region nucleic acid sequence
gacatccagctgactcagtctccatcctccctggctgtgtcagcaggagagaaggtcactatgagctgcaaatccagtcagagtctgctcaacagtagaacccgaaagaactacctggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataaccttcggacgttcggtggagggaccaagctggagctgaaa

SEQ ID NO: 2826 - protein, 112 aa, Artificial Sequence; identical to SEQ ID NO: 2810
  Description of Artificial Sequence: Synthetic Light chain variable region amino acid sequence

SEQ ID NO: 2827 - protein, 17 aa, Artificial Sequence
  Description of Artificial Sequence: Synthetic Light chain variable region CDR L1 amino acid sequence
KSSQSLLNSRTRKNYLA

SEQ ID NO: 2828 - DNA, 51 bp, Artificial Sequence
  Description of Artificial Sequence: Synthetic Light chain variable region CDR L1 nucleic acid sequence
aaatccagtcagagtctgctcaacagtagaacccgaaagaactacctggct

SEQ ID NO: 2829 - protein, 7 aa, Artificial Sequence
  Description of Artificial Sequence: Synthetic Light chain variable region CDR L2 amino acid sequence
WASTRES

SEQ ID NO: 2830 - DNA, 21 bp, Artificial Sequence
  Description of Artificial Sequence: Synthetic Light chain variable region CDR L2 nucleic acid sequence
tgggcatccactagggaatct

SEQ ID NO: 2831 - protein, 8 aa, Artificial Sequence
  Description of Artificial Sequence: Synthetic Light chain variable region CDR L3 amino acid sequence
KQSYNLRT

SEQ ID NO: 2832 - DNA, 24 bp, Artificial Sequence
  Description of Artificial Sequence: Synthetic Light chain variable region CDR L3 nucleic acid sequence
aagcaatcttataaccttcggacg

SEQ ID NO: 2833 - DNA, 351 bp, Artificial Sequence
  Description of Artificial Sequence: Synthetic Heavy chain variable region nucleic acid sequence
gaggttcagctggaggagtctggacctgaactggtgaagcctggggcttcagtgaggatatcctgcaaggcttctggctacaccttcacaagctactatatacactgggtgaagcagaggcctggacagggacttgagtggattggatggatttatcctggaaatgttaatactaagtacaatgagaagttcaagggcaaggccacactgactgcagacaaatcctccagcacagcctacatgcagctcagcagcctgacctctgaggactctgcaatctatttctgtgcaagagatggtaactacttcttcgatgtctggggccaaggcaccacggtcaccgtctcctca

SEQ ID NO: 2834 - protein, 117 aa, Artificial Sequence
  Description of Artificial Sequence: Synthetic Heavy chain variable region amino acid sequence
EVQLEESGPELVKPGASVRISCKASGYTFTSYYIHWVKQRPGQGLEWIGWIYPGNVNTKYNEKFKGKATLTADKSSSTAYMQLSSLTSEDSAIYFCARDGNYFFDVWGQGTTVTVSS

SEQ ID NO: 2835 - protein, 9 aa, Artificial Sequence
  Description of Artificial Sequence: Synthetic Heavy chain variable region CDR H1 amino acid sequence
YTFTSYYIH

SEQ ID NO: 2836 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 2837 - protein, 17 aa, Artificial Sequence
  Description of Artificial Sequence: Synthetic Heavy chain variable region CDR H2 amino acid sequence
WIYPGNVNTKYNEKFKG

SEQ ID NO: 2838 - DNA, 51 bp, Artificial Sequence; identical to SEQ ID NO: 2806
  Description of Artificial Sequence: Synthetic Heavy chain variable region CDR H2 nucleic acid sequence

SEQ ID NO: 2839 - protein, 10 aa, Artificial Sequence
  Description of Artificial Sequence: Synthetic Heavy chain variable region CDR H3 amino acid sequence
ARDGNYFFDV

SEQ ID NO: 2840 - DNA, 30 bp, Artificial Sequence; identical to SEQ ID NO: 2824
  Description of Artificial Sequence: Synthetic Heavy chain variable region CDR H3 nucleic acid sequence

SEQ ID NO: 2841 - DNA, 336 bp, Artificial Sequence
  Description of Artificial Sequence: Synthetic Light chain variable region nucleic acid sequence
gatatcgagctgattcagtctccatcctccctggctgtgtcagcaggagagaaggtcactatgagctgcaaatccagtcagaatctgctcaacagtagaacccgaaagaactacttggcttggtaccggcagaaaccagggcagtctcctaaactgctgatctactgggcatccactagggaatctggggtccctgatcgcttcacaggcagtggatctgggacagatttcactctcaccatcagcagtgtgcaggctgaagacctggcagtatattactgcaagcaatcttataatcttcggacgttcggtggagggaccaagctggagctgaaa

SEQ ID NO: 2842 - protein, 112 aa, Artificial Sequence
  Description of Artificial Sequence: Synthetic Light chain variable region amino acid sequence
DIELIQSPSSLAVSAGEKVTMSCKSSQNLLNSRTRKNYLAWYRQKPGQSPKLLIYWASTRESGVPDRFTGSGSGTDFTLTISSVQAEDLAVYYCKQSYNLRTFGGGTKLELK

SEQ ID NO: 2843 - protein, 17 aa, Artificial Sequence
  Description of Artificial Sequence: Synthetic Light chain variable region CDR L1 amino acid sequence
KSSQNLLNSRTRKNYLA

SEQ ID NO: 2844 - DNA, 51 bp, Artificial Sequence
  Description of Artificial Sequence: Synthetic Light chain variable region CDR L1 nucleic acid sequence
aaatccagtcagaatctgctcaacagtagaacccgaaagaactacttggct

SEQ ID NO: 2845 - protein, 7 aa, Artificial Sequence
  Description of Artificial Sequence: Synthetic Light chain variable region CDR L2 amino acid sequence
WASTRES

SEQ ID NO: 2846 - DNA, 21 bp, Artificial Sequence
  Description of Artificial Sequence: Synthetic Light chain variable region CDR L2 nucleic acid sequence
tgggcatccactagggaatct

SEQ ID NO: 2847 - protein, 8 aa, Artificial Sequence
  Description of Artificial Sequence: Synthetic Light chain variable region CDR L3 amino acid sequence
KQSYNLRT

SEQ ID NO: 2848 - DNA, 24 bp, Artificial Sequence
  Description of Artificial Sequence: Synthetic Light chain variable region CDR L3 nucleic acid sequence
aagcaatcttataatcttcggacg

SEQ ID NO: 2849 - DNA, 354 bp, Artificial Sequence
  Description of Artificial Sequence: Synthetic Heavy chain variable region nucleic acid sequence
caggtaaagctgcagcagtctggacctgagctggtgaagcctggggcttcagtgaggatatcctgcaaggcttctggcaacaccttcacaagctcctatatacactgggtgaagcagaggcctggacagggacttgagtggattggatggatttatcctggaaatgttaatactaagtacaatgagaagttcaagggcaaggccacactgactgcagacaaatcctccagcacagtctacatgcagctcagcagcctgacctctgaggactctgcggtctatttctgtgcaagagacggtagtagctactactttgactactggggccaaggcaccacggtcaccgtctcctca

SEQ ID NO: 2850 - protein, 118 aa, Artificial Sequence
  Description of Artificial Sequence: Synthetic Heavy chain variable region amino acid sequence
QVKLQQSGPELVKPGASVRISCKASGNTFTSSYIHWVKQRPGQGLEWIGWIYPGNVNTKYNEKFKGKATLTADKSSSTVYMQLSSLTSEDSAVYFCARDGSSYYFDYWGQGTTVTVSS

SEQ ID NO: 2851 - protein, 9 aa, Artificial Sequence
  Description of Artificial Sequence: Synthetic Heavy chain variable region CDR H1 amino acid sequence
NTFTSSYIH

SEQ ID NO: 2852 - DNA, 27 bp, Artificial Sequence
  Description of Artificial Sequence: Synthetic Heavy chain variable region CDR H1 nucleic acid sequence
aacaccttcacaagctcctatatacac

SEQ ID NO: 2853 - protein, 17 aa, Artificial Sequence
  Description of Artificial Sequence: Synthetic Heavy chain variable region CDR H2 amino acid sequence
WIYPGNVNTKYNEKFKG

SEQ ID NO: 2854 - DNA, 51 bp, Artificial Sequence; identical to SEQ ID NO: 2806
  Description of Artificial Sequence: Synthetic Heavy chain variable region CDR H2 nucleic acid sequence

SEQ ID NO: 2855 - protein, 11 aa, Artificial Sequence
  Description of Artificial Sequence: Synthetic Heavy chain variable region CDR H3 amino acid sequence
ARDGSSYYFDY

SEQ ID NO: 2856 - DNA, 33 bp, Artificial Sequence
  Description of Artificial Sequence: Synthetic Heavy chain variable region CDR H3 nucleic acid sequence
gcaagagacggtagtagctactactttgactac

SEQ ID NO: 2857 - DNA, 336 bp, Artificial Sequence
  Description of Artificial Sequence: Synthetic Light chain variable region nucleic acid sequence
gacatccagctgactcagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggagggaccaagctggagctgaaa

SEQ ID NO: 2858 - protein, 112 aa, Artificial Sequence; identical to SEQ ID NO: 2810
  Description of Artificial Sequence: Synthetic Light chain variable region amino acid sequence

SEQ ID NO: 2859 - protein, 17 aa, Artificial Sequence
  Description of Artificial Sequence: Synthetic Light chain variable region CDR L1 amino acid sequence
KSSQSLLNSRTRKNYLA

SEQ ID NO: 2860 - DNA, 51 bp, Artificial Sequence; identical to SEQ ID NO: 2764
  Description of Artificial Sequence: Synthetic Light chain variable region CDR L1 nucleic acid sequence

SEQ ID NO: 2861 - protein, 7 aa, Artificial Sequence
  Description of Artificial Sequence: Synthetic Light chain variable region CDR L2 amino acid sequence
WASTRES

SEQ ID NO: 2862 - DNA, 21 bp, Artificial Sequence
  Description of Artificial Sequence: Synthetic Light chain variable region CDR L2 nucleic acid sequence
tgggcatccactagggaatct

SEQ ID NO: 2863 - protein, 8 aa, Artificial Sequence
  Description of Artificial Sequence: Synthetic Light chain variable region CDR L3 amino acid sequence
KQSYNLRT

SEQ ID NO: 2864 - DNA, 24 bp, Artificial Sequence
  Description of Artificial Sequence: Synthetic Light chain variable region CDR L3 nucleic acid sequence
aagcaatcttataatcttcggacg

SEQ ID NO: 2865 - DNA, 351 bp, Artificial Sequence
  Description of Artificial Sequence: Synthetic Heavy chain variable region nucleic acid sequence
gaagtgcagctggagcagtcaggacctgagctggtgaagcctggggcttcagtgaagatgtcctgcaaggcttctggctacaccttcacaagctactatatacactgggtgaagcagaggcctggacagggacttgagtggattggatggatttatcctggagatggtagtactaagtacaatgagaagttcaagggcaagaccacactgactgcagacaaatcctccagcacagcctacatgttgctcagcagcctgacctctgaggactctgcgatctatttctgtgcaagggatggttcgtactactttgactactggggccaaggcaccacggtcaccgtctcctca

SEQ ID NO: 2866 - protein, 117 aa, Artificial Sequence
  Description of Artificial Sequence: Synthetic Heavy chain variable region amino acid sequence
EVQLEQSGPELVKPGASVKMSCKASGYTFTSYYIHWVKQRPGQGLEWIGWIYPGDGSTKYNEKFKGKTTLTADKSSSTAYMLLSSLTSEDSAIYFCARDGSYYFDYWGQGTTVTVSS

SEQ ID NO: 2867 - protein, 9 aa, Artificial Sequence
  Description of Artificial Sequence: Synthetic Heavy chain variable region CDR H1 amino acid sequence
YTFTSYYIH

SEQ ID NO: 2868 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 2869 - protein, 17 aa, Artificial Sequence
  Description of Artificial Sequence: Synthetic Heavy chain variable region CDR H2 amino acid sequence
WIYPGDGSTKYNEKFKG

SEQ ID NO: 2870 - DNA, 51 bp, Artificial Sequence
  Description of Artificial Sequence: Synthetic Heavy chain variable region CDR H2 nucleic acid sequence
tggatttatcctggagatggtagtactaagtacaatgagaagttcaagggc

SEQ ID NO: 2871 - protein, 10 aa, Artificial Sequence
  Description of Artificial Sequence: Synthetic Heavy chain variable region CDR H3 amino acid sequence
ARDGSYYFDY

SEQ ID NO: 2872 - DNA, 30 bp, Artificial Sequence
  Description of Artificial Sequence: Synthetic Heavy chain variable region CDR H3 nucleic acid sequence
gcaagggatggttcgtactactttgactac

SEQ ID NO: 2873 - DNA, 336 bp, Artificial Sequence
  Description of Artificial Sequence: Synthetic Light chain variable region nucleic acid sequence
gacattcagctcacccagtctccatcctccctggctgtgtcagcaggagagaaggtcactatgagctgcaaatccagtcagagtctgctcaacagtagaacccgaaagaactacttggcttggtaccaacagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttatagtcttcggacgttcggtggagggaccaagctggagctgaaa

SEQ ID NO: 2874 - protein, 112 aa, Artificial Sequence
  Description of Artificial Sequence: Synthetic Light chain variable region amino acid sequence
DIQLTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYSLRTFGGGTKLELK

SEQ ID NO: 2875 - protein, 17 aa, Artificial Sequence
  Description of Artificial Sequence: Synthetic Light chain variable region CDR L1 amino acid sequence
KSSQSLLNSRTRKNYLA

SEQ ID NO: 2876 - DNA, 51 bp, Artificial Sequence; identical to SEQ ID NO: 2764
  Description of Artificial Sequence: Synthetic Light chain variable region CDR L1 nucleic acid sequence

SEQ ID NO: 2877 - protein, 7 aa, Artificial Sequence
  Description of Artificial Sequence: Synthetic Light chain variable region CDR L2 amino acid sequence
WASTRES

SEQ ID NO: 2878 - DNA, 21 bp, Artificial Sequence
  Description of Artificial Sequence: Synthetic Light chain variable region CDR L2 nucleic acid sequence
tgggcatccactagggaatct

SEQ ID NO: 2879 - protein, 8 aa, Artificial Sequence
  Description of Artificial Sequence: Synthetic Light chain variable region CDR L3 amino acid sequence
KQSYSLRT

SEQ ID NO: 2880 - DNA, 24 bp, Artificial Sequence
  Description of Artificial Sequence: Synthetic Light chain variable region CDR L3 nucleic acid sequence
aagcaatcttatagtcttcggacg

SEQ ID NO: 2881 - DNA, 351 bp, Artificial Sequence
  Description of Artificial Sequence: Synthetic Heavy chain variable region nucleic acid sequence
gaggtgaagctggaggagtctggacctgagctggtgaagcctggggcttcagtgaagatgtcctgcaaggcttctggctacaccttcacaagctactatatacactgggtgaagcagaggcctggacagggacttgagtggattggatggatttatcctggagatggtagtactaagtacaatgagaagttcaagggcaagaccacactgactgcagacaaatcctccagcacagcctacatgttgctcagcagcctgacctctgaggactctgcgatctatttctgtgcaagggatggttcgtactactttgactactggggccaaggcaccacggtcaccgtctcctca

SEQ ID NO: 2882 - protein, 117 aa, Artificial Sequence
  Description of Artificial Sequence: Synthetic Heavy chain variable region amino acid sequence
EVKLEESGPELVKPGASVKMSCKASGYTFTSYYIHWVKQRPGQGLEWIGWIYPGDGSTKYNEKFKGKTTLTADKSSSTAYMLLSSLTSEDSAIYFCARDGSYYFDYWGQGTTVTVSS

SEQ ID NO: 2883 - protein, 9 aa, Artificial Sequence
  Description of Artificial Sequence: Synthetic Heavy chain variable region CDR H1 amino acid sequence
YTFTSYYIH

SEQ ID NO: 2884 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 2885 - protein, 17 aa, Artificial Sequence
  Description of Artificial Sequence: Synthetic Heavy chain variable region CDR H2 amino acid sequence
WIYPGDGSTKYNEKFKG

SEQ ID NO: 2886 - DNA, 51 bp, Artificial Sequence; identical to SEQ ID NO: 2870
  Description of Artificial Sequence: Synthetic Heavy chain variable region CDR H2 nucleic acid sequence

SEQ ID NO: 2887 - protein, 10 aa, Artificial Sequence
  Description of Artificial Sequence: Synthetic Heavy chain variable region CDR H3 amino acid sequence
ARDGSYYFDY

SEQ ID NO: 2888 - DNA, 30 bp, Artificial Sequence; identical to SEQ ID NO: 2872
  Description of Artificial Sequence: Synthetic Heavy chain variable region CDR H3 nucleic acid sequence

SEQ ID NO: 2889 - DNA, 336 bp, Artificial Sequence
  Description of Artificial Sequence: Synthetic Light chain variable region nucleic acid sequence
gacatccagctgacccagtctccatcctccctggctgtgtcagcaggagagaaggtcactatgagctgcaaatccagtcagagtctgctcaacagtagaacccgaaagaactacttggcttggtaccaacagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttatagtcttcggacgttcggtggagggaccaagctggagctgaaa

SEQ ID NO: 2890 - protein, 112 aa, Artificial Sequence; identical to SEQ ID NO: 2874
  Description of Artificial Sequence: Synthetic Light chain variable region amino acid sequence

SEQ ID NO: 2891 - protein, 17 aa, Artificial Sequence
  Description of Artificial Sequence: Synthetic Light chain variable region CDR L1 amino acid sequence
KSSQSLLNSRTRKNYLA

SEQ ID NO: 2892 - DNA, 51 bp, Artificial Sequence; identical to SEQ ID NO: 2764
  Description of Artificial Sequence: Synthetic Light chain variable region CDR L1 nucleic acid sequence

SEQ ID NO: 2893 - protein, 7 aa, Artificial Sequence
  Description of Artificial Sequence: Synthetic Light chain variable region CDR L2 amino acid sequence
WASTRES

SEQ ID NO: 2894 - DNA, 21 bp, Artificial Sequence
  Description of Artificial Sequence: Synthetic Light chain variable region CDR L2 nucleic acid sequence
tgggcatccactagggaatct

SEQ ID NO: 2895 - protein, 8 aa, Artificial Sequence
  Description of Artificial Sequence: Synthetic Light chain variable region CDR L3 amino acid sequence
KQSYSLRT

SEQ ID NO: 2896 - DNA, 24 bp, Artificial Sequence
  Description of Artificial Sequence: Synthetic Light chain variable region CDR L3 nucleic acid sequence
aagcaatcttatagtcttcggacg

SEQ ID NO: 2897 - DNA, 351 bp, Artificial Sequence
  Description of Artificial Sequence: Synthetic Heavy chain variable region nucleic acid sequence
gaagtcaagctgcaggagtctggacctgagctggtgaagcctggggcttcagtgaagatgtcctgcaaggcttctggctacaccttcacaagctactatatacactgggtgaagcagaggcctggacagggacttgagtggattggatggatttatcctggagatggtagtactaagtacaatgagaagttcaagggcaagaccacactgactgcagacaaatcctccagcacagcctacatgttgctcagcagcctgacctctgaggactctgcgatctatttctgtgcaagggactacgggtactactttgactactggggccaaggcaccacggtcaccgtctcctca

SEQ ID NO: 2898 - protein, 117 aa, Artificial Sequence
  Description of Artificial Sequence: Synthetic Heavy chain variable region amino acid sequence
EVKLQESGPELVKPGASVKMSCKASGYTFTSYYIHWVKQRPGQGLEWIGWIYPGDGSTKYNEKFKGKTTLTADKSSSTAYMLLSSLTSEDSAIYFCARDYGYYFDYWGQGTTVTVSS

SEQ ID NO: 2899 - protein, 9 aa, Artificial Sequence
  Description of Artificial Sequence: Synthetic Heavy chain variable region CDR H1 amino acid sequence
YTFTSYYIH

SEQ ID NO: 2900 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 2901 - protein, 17 aa, Artificial Sequence
  Description of Artificial Sequence: Synthetic Heavy chain variable region CDR H2 amino acid sequence
WIYPGDGSTKYNEKFKG

SEQ ID NO: 2902 - DNA, 51 bp, Artificial Sequence; identical to SEQ ID NO: 2870
  Description of Artificial Sequence: Synthetic Heavy chain variable region CDR H2 nucleic acid sequence

SEQ ID NO: 2903 - protein, 10 aa, Artificial Sequence
  Description of Artificial Sequence: Synthetic Heavy chain variable region CDR H3 amino acid sequence
ARDYGYYFDY

SEQ ID NO: 2904 - DNA, 30 bp, Artificial Sequence
  Description of Artificial Sequence: Synthetic Heavy chain variable region CDR H3 nucleic acid sequence
gcaagggactacgggtactactttgactac

SEQ ID NO: 2905 - DNA, 336 bp, Artificial Sequence; identical to SEQ ID NO: 2809
  Description of Artificial Sequence: Synthetic Light chain variable region nucleic acid sequence

SEQ ID NO: 2906 - protein, 112 aa, Artificial Sequence; identical to SEQ ID NO: 2810
  Description of Artificial Sequence: Synthetic Light chain variable region amino acid sequence

SEQ ID NO: 2907 - protein, 17 aa, Artificial Sequence
  Description of Artificial Sequence: Synthetic Light chain variable region CDR L1 amino acid sequence
KSSQSLLNSRTRKNYLA

SEQ ID NO: 2908 - DNA, 51 bp, Artificial Sequence; identical to SEQ ID NO: 2764
  Description of Artificial Sequence: Synthetic Light chain variable region CDR L1 nucleic acid sequence

SEQ ID NO: 2909 - protein, 7 aa, Artificial Sequence
  Description of Artificial Sequence: Synthetic Light chain variable region CDR L2 amino acid sequence
WASTRES

SEQ ID NO: 2910 - DNA, 21 bp, Artificial Sequence
  Description of Artificial Sequence: Synthetic Light chain variable region CDR L2 nucleic acid sequence
tgggcatccactagggaatct

SEQ ID NO: 2911 - protein, 8 aa, Artificial Sequence
  Description of Artificial Sequence: Synthetic Light chain variable region CDR L3 amino acid sequence
KQSYNLRT

SEQ ID NO: 2912 - DNA, 24 bp, Artificial Sequence
  Description of Artificial Sequence: Synthetic Light chain variable region CDR L3 nucleic acid sequence
aagcaatcttataatcttcggacg

SEQ ID NO: 2913 - DNA, 351 bp, Artificial Sequence
  Description of Artificial Sequence: Synthetic Heavy chain variable region nucleic acid sequence
gaggttaagctggaggagtcaggacctgagctggtgaagcctggggcttcagtgaggatatcctgcaaggcttctggctacaccttcacaagctactatatacactgggtgaagcagaggcctggacagggacttgagtggattggatggatttatcctggaaatgttaatactaagtacaatgagaagttcaagggcaaggccacactgactgcagacaaatcctccagcacagtttatatgcagctcagcagcctgacctctgaggactctgcggtctatttctgtgcaagagactatggttactactttgactattggggccaaggcaccacggtcaccgtctcctca

SEQ ID NO: 2914 - protein, 117 aa, Artificial Sequence
  Description of Artificial Sequence: Synthetic Heavy chain variable region amino acid sequence
EVKLEESGPELVKPGASVRISCKASGYTFTSYYIHWVKQRPGQGLEWIGWIYPGNVNTKYNEKFKGKATLTADKSSSTVYMQLSSLTSEDSAVYFCARDYGYYFDYWGQGTTVTVSS

SEQ ID NO: 2915 - protein, 9 aa, Artificial Sequence
  Description of Artificial Sequence: Synthetic Heavy chain variable region CDR H1 amino acid sequence
YTFTSYYIH

SEQ ID NO: 2916 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 2917 - protein, 17 aa, Artificial Sequence
  Description of Artificial Sequence: Synthetic Heavy chain variable region CDR H2 amino acid sequence
WIYPGNVNTKYNEKFKG

SEQ ID NO: 2918 - DNA, 51 bp, Artificial Sequence; identical to SEQ ID NO: 2806
  Description of Artificial Sequence: Synthetic Heavy chain variable region CDR H2 nucleic acid sequence

SEQ ID NO: 2919 - protein, 10 aa, Artificial Sequence
  Description of Artificial Sequence: Synthetic Heavy chain variable region CDR H3 amino acid sequence
ARDYGYYFDY

SEQ ID NO: 2920 - DNA, 30 bp, Artificial Sequence
  Description of Artificial Sequence: Synthetic Heavy chain variable region CDR H3 nucleic acid sequence
gcaagagactatggttactactttgactat

SEQ ID NO: 2921 - DNA, 336 bp, Artificial Sequence
  Description of Artificial Sequence: Synthetic Light chain variable region nucleic acid sequence
gacattgtgctgacccagtctccatcctccctggctgtgtcagcaggagagaaggtcaccatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggagggaccaagctggagctgaaa

SEQ ID NO: 2922 - protein, 112 aa, Artificial Sequence
  Description of Artificial Sequence: Synthetic Light chain variable region amino acid sequence
DIVLTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLRTFGGGTKLELK

SEQ ID NO: 2923 - protein, 17 aa, Artificial Sequence
  Description of Artificial Sequence: Synthetic Light chain variable region CDR L1 amino acid sequence
KSSQSLLNSRTRKNYLA

SEQ ID NO: 2924 - DNA, 51 bp, Artificial Sequence; identical to SEQ ID NO: 2764
  Description of Artificial Sequence: Synthetic Light chain variable region CDR L1 nucleic acid sequence

SEQ ID NO: 2925 - protein, 7 aa, Artificial Sequence
  Description of Artificial Sequence: Synthetic Light chain variable region CDR L2 amino acid sequence
WASTRES

SEQ ID NO: 2926 - DNA, 21 bp, Artificial Sequence
  Description of Artificial Sequence: Synthetic Light chain variable region CDR L2 nucleic acid sequence
tgggcatccactagggaatct

SEQ ID NO: 2927 - protein, 8 aa, Artificial Sequence
  Description of Artificial Sequence: Synthetic Light chain variable region CDR L3 amino acid sequence
KQSYNLRT

SEQ ID NO: 2928 - DNA, 24 bp, Artificial Sequence
  Description of Artificial Sequence: Synthetic Light chain variable region CDR L3 nucleic acid sequence
aagcaatcttataatcttcggacg

SEQ ID NO: 2929 - DNA, 351 bp, Artificial Sequence
  Description of Artificial Sequence: Synthetic Heavy chain variable region nucleic acid sequence
gaggtgcagctggaggagtcaggacctgagctggtgaggcctggggcttcagtgaggatatcctgcaaggcttctggctacaccttcacaagctcctatatacactgggtgaagcagaggcctggacagggacttgagtggattggatggatttatcctggaaatgttaatactaagtacaatgagaagttcaagggcaaggccacactgactgcagacaaatcctccagcacagcctacatgcacctcagcagcctgacctctgaggactctgcggtctatttctgtgcaagagactatggttactactttgactactggggccaaggcaccacggtcaccgtctcctca

SEQ ID NO: 2930 - protein, 117 aa, Artificial Sequence
  Description of Artificial Sequence: Synthetic Heavy chain variable region amino acid sequence
EVQLEESGPELVRPGASVRISCKASGYTFTSSYIHWVKQRPGQGLEWIGWIYPGNVNTKYNEKFKGKATLTADKSSSTAYMHLSSLTSEDSAVYFCARDYGYYFDYWGQGTTVTVSS

SEQ ID NO: 2931 - protein, 9 aa, Artificial Sequence
  Description of Artificial Sequence: Synthetic Heavy chain variable region CDR H1 amino acid sequence
YTFTSSYIH

SEQ ID NO: 2932 - DNA, 27 bp, Artificial Sequence
  Description of Artificial Sequence: Synthetic Heavy chain variable region CDR H1 nucleic acid sequence
tacaccttcacaagctcctatatacac

SEQ ID NO: 2933 - protein, 17 aa, Artificial Sequence
  Description of Artificial Sequence: Synthetic Heavy chain variable region CDR H2 amino acid sequence
WIYPGNVNTKYNEKFKG

SEQ ID NO: 2934 - DNA, 51 bp, Artificial Sequence; identical to SEQ ID NO: 2806
  Description of Artificial Sequence: Synthetic Heavy chain variable region CDR H2 nucleic acid sequence

SEQ ID NO: 2935 - protein, 10 aa, Artificial Sequence
  Description of Artificial Sequence: Synthetic Heavy chain variable region CDR H3 amino acid sequence
ARDYGYYFDY

SEQ ID NO: 2936 - DNA, 30 bp, Artificial Sequence
  Description of Artificial Sequence: Synthetic Heavy chain variable region CDR H3 nucleic acid sequence
gcaagagactatggttactactttgactac

SEQ ID NO: 2937 - DNA, 336 bp, Artificial Sequence
  Description of Artificial Sequence: Synthetic Light chain variable region nucleic acid sequence
gacattgtgctgacccaatctccatcctccctggctgtgtcagcaggagagaaggtcactatgagctgcaaatccagtcagagtctgctcaacagtagaacccgaaagaactacttggcttggtaccagcagaaagcagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggagggaccaagctggagctgaaa

SEQ ID NO: 2938 - protein, 112 aa, Artificial Sequence
  Description of Artificial Sequence: Synthetic Light chain variable region amino acid sequence
DIVLTQSPSSLAVSAGEKVTMSCKSSQSLLNSRTRKNYLAWYQQKAGQSPKLLIYWASTRESGVPDRFTGSGSGTDFTLTISSVQAEDLAVYYCKQSYNLRTFGGGTKLELK

SEQ ID NO: 2939 - protein, 17 aa, Artificial Sequence
  Description of Artificial Sequence: Synthetic Light chain variable region CDR L1 amino acid sequence
KSSQSLLNSRTRKNYLA

SEQ ID NO: 2940 - DNA, 51 bp, Artificial Sequence; identical to SEQ ID NO: 2764
  Description of Artificial Sequence: Synthetic Light chain variable region CDR L1 nucleic acid sequence

SEQ ID NO: 2941 - protein, 7 aa, Artificial Sequence
  Description of Artificial Sequence: Synthetic Light chain variable region CDR L2 amino acid sequence
WASTRES

SEQ ID NO: 2942 - DNA, 21 bp, Artificial Sequence
  Description of Artificial Sequence: Synthetic Light chain variable region CDR L2 nucleic acid sequence
tgggcatccactagggaatct

SEQ ID NO: 2943 - protein, 8 aa, Artificial Sequence
  Description of Artificial Sequence: Synthetic Light chain variable region CDR L3 amino acid sequence
KQSYNLRT

SEQ ID NO: 2944 - DNA, 24 bp, Artificial Sequence
  Description of Artificial Sequence: Synthetic Light chain variable region CDR L3 nucleic acid sequence
aagcaatcttataatcttcggacg

SEQ ID NO: 2945 - DNA, 351 bp, Artificial Sequence
  Description of Artificial Sequence: Synthetic Heavy chain variable region nucleic acid sequence
gaggttcagctggagcagtcaggacctgagctggtgaagcctggggcttcagtgaggatatcctgcaagtcttctggctacaccttcacaagctactatatacactgggtgaagcagaggcctggacagggacttgagtggattggatggatttatcctggaaatgttaatactaaatacaatgagaagttcaagggcaaggccacactgactgcagacaaatcctccagcacagcctacatgcagctcagcagcctgacctctgaggactctgcggtctatttctgtgcaagagactatggttactactttggctcctggggccaaggcaccacggtcaccgtctcctca

SEQ ID NO: 2946 - protein, 117 aa, Artificial Sequence
  Description of Artificial Sequence: Synthetic Heavy chain variable region amino acid sequence
EVQLEQSGPELVKPGASVRISCKSSGYTFTSYYIHWVKQRPGQGLEWIGWIYPGNVNTKYNEKFKGKATLTADKSSSTAYMQLSSLTSEDSAVYFCARDYGYYFGSWGQGTTVTVSS

SEQ ID NO: 2947 - protein, 9 aa, Artificial Sequence
  Description of Artificial Sequence: Synthetic Heavy chain variable region CDR H1 amino acid sequence
YTFTSYYIH

SEQ ID NO: 2948 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 2949 - protein, 17 aa, Artificial Sequence
  Description of Artificial Sequence: Synthetic Heavy chain variable region CDR H2 amino acid sequence
WIYPGNVNTKYNEKFKG

SEQ ID NO: 2950 - DNA, 51 bp, Artificial Sequence; identical to SEQ ID NO: 2790
  Description of Artificial Sequence: Synthetic Heavy chain variable region CDR H2 nucleic acid sequence

SEQ ID NO: 2951 - protein, 10 aa, Artificial Sequence
  Description of Artificial Sequence: Synthetic Heavy chain variable region CDR H3 amino acid sequence
ARDYGYYFGS

SEQ ID NO: 2952 - DNA, 30 bp, Artificial Sequence
  Description of Artificial Sequence: Synthetic Heavy chain variable region CDR H3 nucleic acid sequence
gcaagagactatggttactactttggctcc

SEQ ID NO: 2953 - DNA, 336 bp, Artificial Sequence
  Description of Artificial Sequence: Synthetic Light chain variable region nucleic acid sequence
gacatccagctcacccagtctccatcctccctggctgtgtcagcaggagagaaggtcactatgaactgcaaatccagtcagagtctgctcaacagtagaacccgaaagaactacttggcttggtaccagcagaaaccagggcagtctcctaaattgctgatctactgggcatccactagggaatctggggtccctgatcgcttcacaggcagtggatctgggacagatttcactctcaccatcagcagtgtgcaggctgaagacctggcagtttattactgtaagcaatcttataatcttcggacgttcggtggaggcacaaagctggaaatcaaa

SEQ ID NO: 2954 - protein, 112 aa, Artificial Sequence
  Description of Artificial Sequence: Synthetic Light chain variable region amino acid sequence
DIQLTQSPSSLAVSAGEKVTMNCKSSQSLLNSRTRKNYLAWYQQKPGQSPKLLIYWASTRESGVPDRFTGSGSGTDFTLTISSVQAEDLAVYYCKQSYNLRTFGGGTKLEIK

SEQ ID NO: 2955 - protein, 17 aa, Artificial Sequence
  Description of Artificial Sequence: Synthetic Light chain variable region CDR L1 amino acid sequence
KSSQSLLNSRTRKNYLA

SEQ ID NO: 2956 - DNA, 51 bp, Artificial Sequence; identical to SEQ ID NO: 2764
  Description of Artificial Sequence: Synthetic Light chain variable region CDR L1 nucleic acid sequence

SEQ ID NO: 2957 - protein, 7 aa, Artificial Sequence
  Description of Artificial Sequence: Synthetic Light chain variable region CDR L2 amino acid sequence
WASTRES

SEQ ID NO: 2958 - DNA, 21 bp, Artificial Sequence
  Description of Artificial Sequence: Synthetic Light chain variable region CDR L2 nucleic acid sequence
tgggcatccactagggaatct

SEQ ID NO: 2959 - protein, 8 aa, Artificial Sequence
  Description of Artificial Sequence: Synthetic Light chain variable region CDR L3 amino acid sequence
KQSYNLRT

SEQ ID NO: 2960 - DNA, 24 bp, Artificial Sequence
  Description of Artificial Sequence: Synthetic Light chain variable region CDR L3 nucleic acid sequence
aagcaatcttataatcttcggacg

SEQ ID NO: 2961 - DNA, 357 bp, Artificial Sequence
  Description of Artificial Sequence: Synthetic Heavy chain variable region nucleic acid sequence
gaagtccagctgcagcagtctggacctgagctggtgaagcctggggcttcagtgaggatatcctgcaaggcttctggttacaccttcacaagctactatatacactgggtgaagcagaggcctggacagggacttgagtggattggatggatttatcctggaaatgttaatactaagtacaatgagaagttcaagggcaaggccacactgactgcagacaaatcctccagcacagtctacatgcagctcagcagcctgacctctgaggactctgcggtctatttctgtggaagagattactacggctcgtactactttgacaactggggccaaggcaccacggtcaccgtctcctca

SEQ ID NO: 2962 - protein, 119 aa, Artificial Sequence
  Description of Artificial Sequence: Synthetic Heavy chain variable region amino acid sequence
EVQLQQSGPELVKPGASVRISCKASGYTFTSYYIHWVKQRPGQGLEWIGWIYPGNVNTKYNEKFKGKATLTADKSSSTVYMQLSSLTSEDSAVYFCGRDYYGSYYFDNWGQGTTVTVSS

SEQ ID NO: 2963 - protein, 9 aa, Artificial Sequence
  Description of Artificial Sequence: Synthetic Heavy chain variable region CDR H1 amino acid sequence
YTFTSYYIH

SEQ ID NO: 2964 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 2965 - protein, 17 aa, Artificial Sequence
  Description of Artificial Sequence: Synthetic Heavy chain variable region CDR H2 amino acid sequence
WIYPGNVNTKYNEKFKG

SEQ ID NO: 2966 - DNA, 51 bp, Artificial Sequence; identical to SEQ ID NO: 2806
  Description of Artificial Sequence: Synthetic Heavy chain variable region CDR H2 nucleic acid sequence

SEQ ID NO: 2967 - protein, 12 aa, Artificial Sequence
  Description of Artificial Sequence: Synthetic Heavy chain variable region CDR H3 amino acid sequence
GRDYYGSYYFDN

SEQ ID NO: 2968 - DNA, 36 bp, Artificial Sequence
  Description of Artificial Sequence: Synthetic Heavy chain variable region CDR H3 nucleic acid sequence
ggaagagattactacggctcgtactactttgacaac

SEQ ID NO: 2969 - DNA, 336 bp, Artificial Sequence
  Description of Artificial Sequence: Synthetic Light chain variable region nucleic acid sequence
gacatccagctgactcagtctccatcctccctggctgtgtcagcaggagagaaggtcactatgagctgcaaatccagtcagagtctgctcaacagtagaacccgaaagaactacttggcttggtaccagcagaaaccagggcagcctcctaaactgctgatctactgggcatccactagggaatctggggtccctgatcgcttcacaggcagtggatctgggacagatttcactctcaccatcagcagtgtgcaggctgaggacctggcagtttattactgcaagcaatcttataatcttcggacgttcggtggaggcacaaagttggaaataaaa

SEQ ID NO: 2970 - protein, 112 aa, Artificial Sequence
  Description of Artificial Sequence: Synthetic Light chain variable region amino acid sequence
DIQLTQSPSSLAVSAGEKVTMSCKSSQSLLNSRTRKNYLAWYQQKPGQPPKLLIYWASTRESGVPDRFTGSGSGTDFTLTISSVQAEDLAVYYCKQSYNLRTFGGGTKLEIK

SEQ ID NO: 2971 - protein, 17 aa, Artificial Sequence
  Description of Artificial Sequence: Synthetic Light chain variable region CDR L1 amino acid sequence
KSSQSLLNSRTRKNYLA

SEQ ID NO: 2972 - DNA, 51 bp, Artificial Sequence; identical to SEQ ID NO: 2764
  Description of Artificial Sequence: Synthetic Light chain variable region CDR L1 nucleic acid sequence

SEQ ID NO: 2973 - protein, 7 aa, Artificial Sequence
  Description of Artificial Sequence: Synthetic Light chain variable region CDR L2 amino acid sequence
WASTRES

SEQ ID NO: 2974 - DNA, 21 bp, Artificial Sequence
  Description of Artificial Sequence: Synthetic Light chain variable region CDR L2 nucleic acid sequence
tgggcatccactagggaatct

SEQ ID NO: 2975 - protein, 8 aa, Artificial Sequence
  Description of Artificial Sequence: Synthetic Light chain variable region CDR L3 amino acid sequence
KQSYNLRT

SEQ ID NO: 2976 - DNA, 24 bp, Artificial Sequence
  Description of Artificial Sequence: Synthetic Light chain variable region CDR L3 nucleic acid sequence
aagcaatcttataatcttcggacg

SEQ ID NO: 2977 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctactatatacactgggtgcgacaggcccctggacaagggcttgagtggatgggatggatctaccctggtgatggtagcacaaagtacaacgagaagttcaagggcagagtcaccatgaccagggacacgtccacgagcacagtctacatggagctgagcagcctgagatctgaggacacggcggtgtactactgcgctagggatggctcctactactttgactactggggccaaggaaccctggtcaccgtctcctca

SEQ ID NO: 2978 - protein, 117 aa, Artificial Sequence
  Description of Artificial Sequence: Synthetic Heavy chain variable region amino acid sequence
QVQLVQSGAEVKKPGASVKVSCKASGYTFTSYYIHWVRQAPGQGLEWMGWIYPGDGSTKYNEKFKGRVTMTRDTSTSTVYMELSSLRSEDTAVYYCARDGSYYFDYWGQGTLVTVSS

SEQ ID NO: 2979 - protein, 9 aa, Artificial Sequence
  Description of Artificial Sequence: Synthetic Heavy chain variable region CDR H1 amino acid sequence
YTFTSYYIH

SEQ ID NO: 2980 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 2981 - protein, 17 aa, Artificial Sequence
  Description of Artificial Sequence: Synthetic Heavy chain variable region CDR H2 amino acid sequence
WIYPGDGSTKYNEKFKG

SEQ ID NO: 2982 - DNA, 51 bp, Artificial Sequence
  Description of Artificial Sequence: Synthetic Heavy chain variable region CDR H2 nucleic acid sequence
tggatctaccctggtgatggtagcacaaagtacaacgagaagttcaagggc

SEQ ID NO: 2983 - protein, 10 aa, Artificial Sequence
  Description of Artificial Sequence: Synthetic Heavy chain variable region CDR H3 amino acid sequence
ARDGSYYFDY

SEQ ID NO: 2984 - DNA, 30 bp, Artificial Sequence
  Description of Artificial Sequence: Synthetic Heavy chain variable region CDR H3 nucleic acid sequence
gctagggatggctcctactactttgactac

SEQ ID NO: 2985 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcaatcttattctctgagaactttcggcggagggaccaaggtggagatcaaa

SEQ ID NO: 2986 - protein, 112 aa, Artificial Sequence
  Description of Artificial Sequence: Synthetic Light chain variable region amino acid sequence
DIVMTQSPDSLAVSLGERATINCKSSQSLLNSRTRKNYLAWYQQKPGQPPKLLIYWASTRESGVPDRFSGSGSGTDFTLTISSLQAEDVAVYYCKQSYSLRTFGGGTKVEIK

SEQ ID NO: 2987 - protein, 17 aa, Artificial Sequence
  Description of Artificial Sequence: Synthetic Light chain variable region CDR L1 amino acid sequence
KSSQSLLNSRTRKNYLA

SEQ ID NO: 2988 - DNA, 51 bp, Artificial Sequence
  Description of Artificial Sequence: Synthetic Light chain variable region CDR L1 nucleic acid sequence
aagtccagccagagtcttttaaacagcagaaccagaaagaactacttagct

SEQ ID NO: 2989 - protein, 7 aa, Artificial Sequence
  Description of Artificial Sequence: Synthetic Light chain variable region CDR L2 amino acid sequence
WASTRES

SEQ ID NO: 2990 - DNA, 21 bp, Artificial Sequence
  Description of Artificial Sequence: Synthetic Light chain variable region CDR L2 nucleic acid sequence
tgggcatctacccgggaatcc

SEQ ID NO: 2991 - protein, 8 aa, Artificial Sequence
  Description of Artificial Sequence: Synthetic Light chain variable region CDR L3 amino acid sequence
KQSYSLRT

SEQ ID NO: 2992 - DNA, 24 bp, Artificial Sequence
  Description of Artificial Sequence: Synthetic Light chain variable region CDR L3 nucleic acid sequence
aagcaatcttattctctgagaact

SEQ ID NO: 2993 - DNA, 351 bp, Artificial Sequence
  Description of Artificial Sequence: Synthetic Heavy chain variable region nucleic acid sequence
caggtgcagctggtgcagtctggggctgaggtgaagaagcctgggtcctcagtgaaggtttcctgcaaggcatctggatacaccttcaccagctactatatacactgggtgcgacaggcccctggacaagggcttgagtggatgggatggatctaccctggtgatggtagcacaaagtacaacgagaagttcaagggcagagtcaccataaccgcggacaagtccacgagcacagcctacatggagctgagcagcctgagatctgaggacacggcggtgtactactgcgcgagggatggaagctattactttgactactggggccaaggaaccctggtcaccgtctcctca

SEQ ID NO: 2994 - protein, 117 aa, Artificial Sequence
  Description of Artificial Sequence: Synthetic Heavy chain variable region amino acid sequence
QVQLVQSGAEVKKPGSSVKVSCKASGYTFTSYYIHWVRQAPGQGLEWMGWIYPGDGSTKYNEKFKGRVTITADKSTSTAYMELSSLRSEDTAVYYCARDGSYYFDYWGQGTLVTVSS

SEQ ID NO: 2995 - protein, 9 aa, Artificial Sequence
  Description of Artificial Sequence: Synthetic Heavy chain variable region CDR H1 amino acid sequence
YTFTSYYIH

SEQ ID NO: 2996 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 2997 - protein, 17 aa, Artificial Sequence
  Description of Artificial Sequence: Synthetic Heavy chain variable region CDR H2 amino acid sequence
WIYPGDGSTKYNEKFKG

SEQ ID NO: 2998 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 2999 - protein, 10 aa, Artificial Sequence
  Description of Artificial Sequence: Synthetic Heavy chain variable region CDR H3 amino acid sequence
ARDGSYYFDY

SEQ ID NO: 3000 - DNA, 30 bp, Artificial Sequence
  Description of Artificial Sequence: Synthetic Heavy chain variable region CDR H3 nucleic acid sequence
gcgagggatggaagctattactttgactac

SEQ ID NO: 3001 - DNA, 336 bp, Artificial Sequence; identical to SEQ ID NO: 2985
  Description of Artificial Sequence: Synthetic Light chain variable region nucleic acid sequence

SEQ ID NO: 3002 - protein, 112 aa, Artificial Sequence; identical to SEQ ID NO: 2986
  Description of Artificial Sequence: Synthetic Light chain variable region amino acid sequence

SEQ ID NO: 3003 - protein, 17 aa, Artificial Sequence
  Description of Artificial Sequence: Synthetic Light chain variable region CDR L1 amino acid sequence
KSSQSLLNSRTRKNYLA

SEQ ID NO: 3004 - DNA, 51 bp, Artificial Sequence; identical to SEQ ID NO: 2988
  Description of Artificial Sequence: Synthetic Light chain variable region CDR L1 nucleic acid sequence

SEQ ID NO: 3005 - protein, 7 aa, Artificial Sequence
  Description of Artificial Sequence: Synthetic Light chain variable region CDR L2 amino acid sequence
WASTRES

SEQ ID NO: 3006 - DNA, 21 bp, Artificial Sequence
  Description of Artificial Sequence: Synthetic Light chain variable region CDR L2 nucleic acid sequence
tgggcatctacccgggaatcc

SEQ ID NO: 3007 - protein, 8 aa, Artificial Sequence
  Description of Artificial Sequence: Synthetic Light chain variable region CDR L3 amino acid sequence
KQSYSLRT

SEQ ID NO: 3008 - DNA, 24 bp, Artificial Sequence
  Description of Artificial Sequence: Synthetic Light chain variable region CDR L3 nucleic acid sequence
aagcaatcttattctctgagaact

SEQ ID NO: 3009 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctactatatacactgggtgcgacaggcccctggacaagggcttgagtggataggatggatctaccctggtgatggtagcacaaagtacaacgagaagttcaagggcagagtcaccatgaccgcggacaagtccacgagcacagcctacatggagctgagcagcctgagatctgaggacacggcggtgtactactgcgccagggatggttcctattactttgactactggggccaaggaaccctggtcaccgtctcctca

SEQ ID NO: 3010 - protein, 117 aa, Artificial Sequence
  Description of Artificial Sequence: Synthetic Heavy chain variable region amino acid sequence
QVQLVQSGAEVKKPGASVKVSCKASGYTFTSYYIHWVRQAPGQGLEWIGWIYPGDGSTKYNEKFKGRVTMTADKSTSTAYMELSSLRSEDTAVYYCARDGSYYFDYWGQGTLVTVSS

SEQ ID NO: 3011 - protein, 9 aa, Artificial Sequence
  Description of Artificial Sequence: Synthetic Heavy chain variable region CDR H1 amino acid sequence
YTFTSYYIH

SEQ ID NO: 3012 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 3013 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3014 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3015 - protein, 10 aa, Artificial Sequence
  Description of Artificial Sequence: Synthetic Heavy chain variable region CDR H3 amino acid sequence
ARDGSYYFDY

SEQ ID NO: 3016 - DNA, 30 bp, Artificial Sequence
  Description of Artificial Sequence: Synthetic Heavy chain variable region CDR H3 nucleic acid sequence
gccagggatggttcctattactttgactac

SEQ ID NO: 3017 - DNA, 336 bp, Artificial Sequence; identical to SEQ ID NO: 2985
  Description of Artificial Sequence: Synthetic Light chain variable region nucleic acid sequence

SEQ ID NO: 3018 - protein, 112 aa, Artificial Sequence; identical to SEQ ID NO: 2986
  Description of Artificial Sequence: Synthetic Light chain variable region amino acid sequence

SEQ ID NO: 3019 - protein, 17 aa, Artificial Sequence
  Description of Artificial Sequence: Synthetic Light chain variable region CDR L1 amino acid sequence
KSSQSLLNSRTRKNYLA

SEQ ID NO: 3020 - DNA, 51 bp, Artificial Sequence; identical to SEQ ID NO: 2988
  Description of Artificial Sequence: Synthetic Light chain variable region CDR L1 nucleic acid sequence

SEQ ID NO: 3021 - protein, 7 aa, Artificial Sequence
  Description of Artificial Sequence: Synthetic Light chain variable region CDR L2 amino acid sequence
WASTRES

SEQ ID NO: 3022 - DNA, 21 bp, Artificial Sequence
  Description of Artificial Sequence: Synthetic Light chain variable region CDR L2 nucleic acid sequence
tgggcatctacccgggaatcc

SEQ ID NO: 3023 - protein, 8 aa, Artificial Sequence
  Description of Artificial Sequence: Synthetic Light chain variable region CDR L3 amino acid sequence
KQSYSLRT

SEQ ID NO: 3024 - DNA, 24 bp, Artificial Sequence
  Description of Artificial Sequence: Synthetic Light chain variable region CDR L3 nucleic acid sequence
aagcaatcttattctctgagaact

SEQ ID NO: 3025 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctactatatacactgggtgcgacaggcccctggacaagggcttgagtggatgggatggatctaccctggtgatggtagcacaaagtacaacgagaagttcaagggcagagtcaccatgaccgcggacaagtccacgagcacagcctacatggagctgagcagcctgagatctgaggacacggcggtgtactactgcgctagagatggctcatattactttgactactggggccaaggaaccctggtcaccgtctcctca

SEQ ID NO: 3026 - protein, 117 aa, Artificial Sequence
  Description of Artificial Sequence: Synthetic Heavy chain variable region amino acid sequence
QVQLVQSGAEVKKPGASVKVSCKASGYTFTSYYIHWVRQAPGQGLEWMGWIYPGDGSTKYNEKFKGRVTMTADKSTSTAYMELSSLRSEDTAVYYCARDGSYYFDYWGQGTLVTVSS

SEQ ID NO: 3027 - protein, 9 aa, Artificial Sequence
  Description of Artificial Sequence: Synthetic Heavy chain variable region CDR H1 amino acid sequence
YTFTSYYIH

SEQ ID NO: 3028 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 3029 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3030 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3031 - protein, 10 aa, Artificial Sequence
  Description of Artificial Sequence: Synthetic Heavy chain variable region CDR H3 amino acid sequence
ARDGSYYFDY

SEQ ID NO: 3032 - DNA, 30 bp, Artificial Sequence
  Description of Artificial Sequence: Synthetic Heavy chain variable region CDR H3 nucleic acid sequence
gctagagatggctcatattactttgactac

SEQ ID NO: 3033 - DNA, 336 bp, Artificial Sequence; identical to SEQ ID NO: 2985
  Description of Artificial Sequence: Synthetic Light chain variable region nucleic acid sequence

SEQ ID NO: 3034 - protein, 112 aa, Artificial Sequence; identical to SEQ ID NO: 2986
  Description of Artificial Sequence: Synthetic Light chain variable region amino acid sequence

SEQ ID NO: 3035 - protein, 17 aa, Artificial Sequence
  Description of Artificial Sequence: Synthetic Light chain variable region CDR L1 amino acid sequence
KSSQSLLNSRTRKNYLA

SEQ ID NO: 3036 - DNA, 51 bp, Artificial Sequence; identical to SEQ ID NO: 2988
  Description of Artificial Sequence: Synthetic Light chain variable region CDR L1 nucleic acid sequence

SEQ ID NO: 3037 - protein, 7 aa, Artificial Sequence
  Description of Artificial Sequence: Synthetic Light chain variable region CDR L2 amino acid sequence
WASTRES

SEQ ID NO: 3038 - DNA, 21 bp, Artificial Sequence
  Description of Artificial Sequence: Synthetic Light chain variable region CDR L2 nucleic acid sequence
tgggcatctacccgggaatcc

SEQ ID NO: 3039 - protein, 8 aa, Artificial Sequence
  Description of Artificial Sequence: Synthetic Light chain variable region CDR L3 amino acid sequence
KQSYSLRT

SEQ ID NO: 3040 - DNA, 24 bp, Artificial Sequence
  Description of Artificial Sequence: Synthetic Light chain variable region CDR L3 nucleic acid sequence
aagcaatcttattctctgagaact

SEQ ID NO: 3041 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctactatatacactgggtgcgacaggcccctggacaagggcttgagtggataggatggatctaccctggtgatggtagcacaaagtacaacgagaagttcaagggcagaaccaccctgaccgcggacaagtccacgagcacagcctacatggagctgagcagcctgagatctgaggacacggcggtgtactactgcgctagagacggatcttattactttgactactggggccaaggaaccctggtcaccgtctcctca

SEQ ID NO: 3042 - protein, 117 aa, Artificial Sequence
  Description of Artificial Sequence: Synthetic Heavy chain variable region amino acid sequence
QVQLVQSGAEVKKPGASVKVSCKASGYTFTSYYIHWVRQAPGQGLEWIGWIYPGDGSTKYNEKFKGRTTLTADKSTSTAYMELSSLRSEDTAVYYCARDGSYYFDYWGQGTLVTVSS

SEQ ID NO: 3043 - protein, 9 aa, Artificial Sequence
  Description of Artificial Sequence: Synthetic Heavy chain variable region CDR H1 amino acid sequence
YTFTSYYIH

SEQ ID NO: 3044 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 3045 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3046 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3047 - protein, 10 aa, Artificial Sequence
  Description of Artificial Sequence: Synthetic Heavy chain variable region CDR H3 amino acid sequence
ARDGSYYFDY

SEQ ID NO: 3048 - DNA, 30 bp, Artificial Sequence
  Description of Artificial Sequence: Synthetic Heavy chain variable region CDR H3 nucleic acid sequence
gctagagacggatcttattactttgactac

SEQ ID NO: 3049 - DNA, 336 bp, Artificial Sequence; identical to SEQ ID NO: 2985
  Description of Artificial Sequence: Synthetic Light chain variable region nucleic acid sequence

SEQ ID NO: 3050 - protein, 112 aa, Artificial Sequence; identical to SEQ ID NO: 2986
  Description of Artificial Sequence: Synthetic Light chain variable region amino acid sequence

SEQ ID NO: 3051 - protein, 17 aa, Artificial Sequence
  Description of Artificial Sequence: Synthetic Light chain variable region CDR L1 amino acid sequence
KSSQSLLNSRTRKNYLA

SEQ ID NO: 3052 - DNA, 51 bp, Artificial Sequence; identical to SEQ ID NO: 2988
  Description of Artificial Sequence: Synthetic Light chain variable region CDR L1 nucleic acid sequence

SEQ ID NO: 3053 - protein, 7 aa, Artificial Sequence
  Description of Artificial Sequence: Synthetic Light chain variable region CDR L2 amino acid sequence
WASTRES

SEQ ID NO: 3054 - DNA, 21 bp, Artificial Sequence
  Description of Artificial Sequence: Synthetic Light chain variable region CDR L2 nucleic acid sequence
tgggcatctacccgggaatcc

SEQ ID NO: 3055 - protein, 8 aa, Artificial Sequence
  Description of Artificial Sequence: Synthetic Light chain variable region CDR L3 amino acid sequence
KQSYSLRT

SEQ ID NO: 3056 - DNA, 24 bp, Artificial Sequence
  Description of Artificial Sequence: Synthetic Light chain variable region CDR L3 nucleic acid sequence
aagcaatcttattctctgagaact

SEQ ID NO: 3057 - DNA, 351 bp, Artificial Sequence
  Description of Artificial Sequence: Synthetic Heavy chain variable region nucleic acid sequence
caggtgcagctggtgcagtctggggctgaggtgaagaagcctgggtcctcagtgaaggtttcctgcaaggcatctggatacaccttcaccagctactatatacactgggtgcgacaggcccctggacaagggcttgagtggataggatggatctaccctggtgatggtagcacaaagtacaacgagaagttcaagggcagaaccaccctgaccgcggacaagtccacgagcacagcctacatggagctgagcagcctgagatctgaggacacggcggtgtactactgcgcgagagatggtagctactactttgactactggggccaaggaaccctggtcaccgtctcctca

SEQ ID NO: 3058 - protein, 117 aa, Artificial Sequence
  Description of Artificial Sequence: Synthetic Heavy chain variable region amino acid sequence
QVQLVQSGAEVKKPGSSVKVSCKASGYTFTSYYIHWVRQAPGQGLEWIGWIYPGDGSTKYNEKFKGRTTLTADKSTSTAYMELSSLRSEDTAVYYCARDGSYYFDYWGQGTLVTVSS

SEQ ID NO: 3059 - protein, 9 aa, Artificial Sequence
  Description of Artificial Sequence: Synthetic Heavy chain variable region CDR H1 amino acid sequence
YTFTSYYIH

SEQ ID NO: 3060 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 3061 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3062 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3063 - protein, 10 aa, Artificial Sequence
  Description of Artificial Sequence: Synthetic Heavy chain variable region CDR H3 amino acid sequence
ARDGSYYFDY

SEQ ID NO: 3064 - DNA, 30 bp, Artificial Sequence
  Description of Artificial Sequence: Synthetic Heavy chain variable region CDR H3 nucleic acid sequence
gcgagagatggtagctactactttgactac

SEQ ID NO: 3065 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcaatcttattctcttagaactttcggcggagggaccaaggtggagatcaaa

SEQ ID NO: 3066 - protein, 112 aa, Artificial Sequence; identical to SEQ ID NO: 2986
  Description of Artificial Sequence: Synthetic Light chain variable region amino acid sequence

SEQ ID NO: 3067 - protein, 17 aa, Artificial Sequence
  Description of Artificial Sequence: Synthetic Light chain variable region CDR L1 amino acid sequence
KSSQSLLNSRTRKNYLA

SEQ ID NO: 3068 - DNA, 51 bp, Artificial Sequence; identical to SEQ ID NO: 2988
  Description of Artificial Sequence: Synthetic Light chain variable region CDR L1 nucleic acid sequence

SEQ ID NO: 3069 - protein, 7 aa, Artificial Sequence
  Description of Artificial Sequence: Synthetic Light chain variable region CDR L2 amino acid sequence
WASTRES

SEQ ID NO: 3070 - DNA, 21 bp, Artificial Sequence
  Description of Artificial Sequence: Synthetic Light chain variable region CDR L2 nucleic acid sequence
tgggcatctacccgggaatcc

SEQ ID NO: 3071 - protein, 8 aa, Artificial Sequence
  Description of Artificial Sequence: Synthetic Light chain variable region CDR L3 amino acid sequence
KQSYSLRT

SEQ ID NO: 3072 - DNA, 24 bp, Artificial Sequence
  Description of Artificial Sequence: Synthetic Light chain variable region CDR L3 nucleic acid sequence
aagcaatcttattctcttagaact

SEQ ID NO: 3073 - DNA, 351 bp, Artificial Sequence; identical to SEQ ID NO: 2977
  Description of Artificial Sequence: Synthetic Heavy chain variable region nucleic acid sequence

SEQ ID NO: 3074 - protein, 117 aa, Artificial Sequence; identical to SEQ ID NO: 2978
  Description of Artificial Sequence: Synthetic Heavy chain variable region amino acid sequence

SEQ ID NO: 3075 - protein, 9 aa, Artificial Sequence
  Description of Artificial Sequence: Synthetic Heavy chain variable region CDR H1 amino acid sequence
YTFTSYYIH

SEQ ID NO: 3076 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 3077 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3078 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3079 - protein, 10 aa, Artificial Sequence
  Description of Artificial Sequence: Synthetic Heavy chain variable region CDR H3 amino acid sequence
ARDGSYYFDY

SEQ ID NO: 3080 - DNA, 30 bp, Artificial Sequence; identical to SEQ ID NO: 2984
  Description of Artificial Sequence: Synthetic Heavy chain variable region CDR H3 nucleic acid sequence

SEQ ID NO: 3081 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcagagttacaatttgagaactttcggcggagggaccaaggtggagatcaaa

SEQ ID NO: 3082 - protein, 112 aa, Artificial Sequence
  Description of Artificial Sequence: Synthetic Light chain variable region amino acid sequence
DIVMTQSPDSLAVSLGERATINCKSSQSLLNSRTRKNYLAWYQQKPGQPPKLLIYWASTRESGVPDRFSGSGSGTDFTLTISSLQAEDVAVYYCKQSYNLRTFGGGTKVEIK

SEQ ID NO: 3083 - protein, 17 aa, Artificial Sequence
  Description of Artificial Sequence: Synthetic Light chain variable region CDR L1 amino acid sequence
KSSQSLLNSRTRKNYLA

SEQ ID NO: 3084 - DNA, 51 bp, Artificial Sequence; identical to SEQ ID NO: 2988
  Description of Artificial Sequence: Synthetic Light chain variable region CDR L1 nucleic acid sequence

SEQ ID NO: 3085 - protein, 7 aa, Artificial Sequence
  Description of Artificial Sequence: Synthetic Light chain variable region CDR L2 amino acid sequence
WASTRES

SEQ ID NO: 3086 - DNA, 21 bp, Artificial Sequence
  Description of Artificial Sequence: Synthetic Light chain variable region CDR L2 nucleic acid sequence
tgggcatctacccgggaatcc

SEQ ID NO: 3087 - protein, 8 aa, Artificial Sequence
  Description of Artificial Sequence: Synthetic Light chain variable region CDR L3 amino acid sequence
KQSYNLRT

SEQ ID NO: 3088 - DNA, 24 bp, Artificial Sequence
  Description of Artificial Sequence: Synthetic Light chain variable region CDR L3 nucleic acid sequence
aagcagagttacaatttgagaact

SEQ ID NO: 3089 - DNA, 351 bp, Artificial Sequence; identical to SEQ ID NO: 2993
  Description of Artificial Sequence: Synthetic Heavy chain variable region nucleic acid sequence

SEQ ID NO: 3090 - protein, 117 aa, Artificial Sequence; identical to SEQ ID NO: 2994
  Description of Artificial Sequence: Synthetic Heavy chain variable region amino acid sequence

SEQ ID NO: 3091 - protein, 9 aa, Artificial Sequence
  Description of Artificial Sequence: Synthetic Heavy chain variable region CDR H1 amino acid sequence
YTFTSYYIH

SEQ ID NO: 3092 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 3093 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3094 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3095 - protein, 10 aa, Artificial Sequence
  Description of Artificial Sequence: Synthetic Heavy chain variable region CDR H3 amino acid sequence
ARDGSYYFDY

SEQ ID NO: 3096 - DNA, 30 bp, Artificial Sequence; identical to SEQ ID NO: 3000
  Description of Artificial Sequence: Synthetic Heavy chain variable region CDR H3 nucleic acid sequence

SEQ ID NO: 3097 - DNA, 336 bp, Artificial Sequence; identical to SEQ ID NO: 3081
  Description of Artificial Sequence: Synthetic Light chain variable region nucleic acid sequence

SEQ ID NO: 3098 - protein, 112 aa, Artificial Sequence; identical to SEQ ID NO: 3082
  Description of Artificial Sequence: Synthetic Light chain variable region amino acid sequence

SEQ ID NO: 3099 - protein, 17 aa, Artificial Sequence
  Description of Artificial Sequence: Synthetic Light chain variable region CDR L1 amino acid sequence
KSSQSLLNSRTRKNYLA

SEQ ID NO: 3100 - DNA, 51 bp, Artificial Sequence; identical to SEQ ID NO: 2988
  Description of Artificial Sequence: Synthetic Light chain variable region CDR L1 nucleic acid sequence

SEQ ID NO: 3101 - protein, 7 aa, Artificial Sequence
  Description of Artificial Sequence: Synthetic Light chain variable region CDR L2 amino acid sequence
WASTRES

SEQ ID NO: 3102 - DNA, 21 bp, Artificial Sequence
  Description of Artificial Sequence: Synthetic Light chain variable region CDR L2 nucleic acid sequence
tgggcatctacccgggaatcc

SEQ ID NO: 3103 - protein, 8 aa, Artificial Sequence
  Description of Artificial Sequence: Synthetic Light chain variable region CDR L3 amino acid sequence
KQSYNLRT

SEQ ID NO: 3104 - DNA, 24 bp, Artificial Sequence
  Description of Artificial Sequence: Synthetic Light chain variable region CDR L3 nucleic acid sequence
aagcagagttacaatttgagaact

SEQ ID NO: 3105 - DNA, 351 bp, Artificial Sequence; identical to SEQ ID NO: 3009
  Description of Artificial Sequence: Synthetic Heavy chain variable region nucleic acid sequence

SEQ ID NO: 3106 - protein, 117 aa, Artificial Sequence; identical to SEQ ID NO: 3010
  Description of Artificial Sequence: Synthetic Heavy chain variable region amino acid sequence

SEQ ID NO: 3107 - protein, 9 aa, Artificial Sequence
  Description of Artificial Sequence: Synthetic Heavy chain variable region CDR H1 amino acid sequence
YTFTSYYIH

SEQ ID NO: 3108 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 3109 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3110 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3111 - protein, 10 aa, Artificial Sequence
  Description of Artificial Sequence: Synthetic Heavy chain variable region CDR H3 amino acid sequence
ARDGSYYFDY

SEQ ID NO: 3112 - DNA, 30 bp, Artificial Sequence; identical to SEQ ID NO: 3016
  Description of Artificial Sequence: Synthetic Heavy chain variable region CDR H3 nucleic acid sequence

SEQ ID NO: 3113 - DNA, 336 bp, Artificial Sequence; identical to SEQ ID NO: 3081
  Description of Artificial Sequence: Synthetic Light chain variable region nucleic acid sequence

SEQ ID NO: 3114 - protein, 112 aa, Artificial Sequence; identical to SEQ ID NO: 3082
  Description of Artificial Sequence: Synthetic Light chain variable region amino acid sequence

SEQ ID NO: 3115 - protein, 17 aa, Artificial Sequence
  Description of Artificial Sequence: Synthetic Light chain variable region CDR L1 amino acid sequence
KSSQSLLNSRTRKNYLA

SEQ ID NO: 3116 - DNA, 51 bp, Artificial Sequence; identical to SEQ ID NO: 2988
  Description of Artificial Sequence: Synthetic Light chain variable region CDR L1 nucleic acid sequence

SEQ ID NO: 3117 - protein, 7 aa, Artificial Sequence
  Description of Artificial Sequence: Synthetic Light chain variable region CDR L2 amino acid sequence
WASTRES

SEQ ID NO: 3118 - DNA, 21 bp, Artificial Sequence
  Description of Artificial Sequence: Synthetic Light chain variable region CDR L2 nucleic acid sequence
tgggcatctacccgggaatcc

SEQ ID NO: 3119 - protein, 8 aa, Artificial Sequence
  Description of Artificial Sequence: Synthetic Light chain variable region CDR L3 amino acid sequence
KQSYNLRT

SEQ ID NO: 3120 - DNA, 24 bp, Artificial Sequence
  Description of Artificial Sequence: Synthetic Light chain variable region CDR L3 nucleic acid sequence
aagcagagttacaatttgagaact

SEQ ID NO: 3121 - DNA, 351 bp, Artificial Sequence; identical to SEQ ID NO: 3025
  Description of Artificial Sequence: Synthetic Heavy chain variable region nucleic acid sequence

SEQ ID NO: 3122 - protein, 117 aa, Artificial Sequence; identical to SEQ ID NO: 3026
  Description of Artificial Sequence: Synthetic Heavy chain variable region amino acid sequence

SEQ ID NO: 3123 - protein, 9 aa, Artificial Sequence
  Description of Artificial Sequence: Synthetic Heavy chain variable region CDR H1 amino acid sequence
YTFTSYYIH

SEQ ID NO: 3124 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 3125 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3126 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3127 - protein, 10 aa, Artificial Sequence
  Description of Artificial Sequence: Synthetic Heavy chain variable region CDR H3 amino acid sequence
ARDGSYYFDY

SEQ ID NO: 3128 - DNA, 30 bp, Artificial Sequence; identical to SEQ ID NO: 3032
  Description of Artificial Sequence: Synthetic Heavy chain variable region CDR H3 nucleic acid sequence

SEQ ID NO: 3129 - DNA, 336 bp, Artificial Sequence; identical to SEQ ID NO: 3081
  Description of Artificial Sequence: Synthetic Light chain variable region nucleic acid sequence

SEQ ID NO: 3130 - protein, 112 aa, Artificial Sequence; identical to SEQ ID NO: 3082
  Description of Artificial Sequence: Synthetic Light chain variable region amino acid sequence

SEQ ID NO: 3131 - protein, 17 aa, Artificial Sequence
  Description of Artificial Sequence: Synthetic Light chain variable region CDR L1 amino acid sequence
KSSQSLLNSRTRKNYLA

SEQ ID NO: 3132 - DNA, 51 bp, Artificial Sequence; identical to SEQ ID NO: 2988
  Description of Artificial Sequence: Synthetic Light chain variable region CDR L1 nucleic acid sequence

SEQ ID NO: 3133 - protein, 7 aa, Artificial Sequence
  Description of Artificial Sequence: Synthetic Light chain variable region CDR L2 amino acid sequence
WASTRES

SEQ ID NO: 3134 - DNA, 21 bp, Artificial Sequence
  Description of Artificial Sequence: Synthetic Light chain variable region CDR L2 nucleic acid sequence
tgggcatctacccgggaatcc

SEQ ID NO: 3135 - protein, 8 aa, Artificial Sequence
  Description of Artificial Sequence: Synthetic Light chain variable region CDR L3 amino acid sequence
KQSYNLRT

SEQ ID NO: 3136 - DNA, 24 bp, Artificial Sequence
  Description of Artificial Sequence: Synthetic Light chain variable region CDR L3 nucleic acid sequence
aagcagagttacaatttgagaact

SEQ ID NO: 3137 - DNA, 351 bp, Artificial Sequence; identical to SEQ ID NO: 3041
  Description of Artificial Sequence: Synthetic Heavy chain variable region nucleic acid sequence

SEQ ID NO: 3138 - protein, 117 aa, Artificial Sequence; identical to SEQ ID NO: 3042
  Description of Artificial Sequence: Synthetic Heavy chain variable region amino acid sequence

SEQ ID NO: 3139 - protein, 9 aa, Artificial Sequence
  Description of Artificial Sequence: Synthetic Heavy chain variable region CDR H1 amino acid sequence
YTFTSYYIH

SEQ ID NO: 3140 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 3141 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3142 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3143 - protein, 10 aa, Artificial Sequence
  Description of Artificial Sequence: Synthetic Heavy chain variable region CDR H3 amino acid sequence
ARDGSYYFDY

SEQ ID NO: 3144 - DNA, 30 bp, Artificial Sequence; identical to SEQ ID NO: 3048
  Description of Artificial Sequence: Synthetic Heavy chain variable region CDR H3 nucleic acid sequence

SEQ ID NO: 3145 - DNA, 336 bp, Artificial Sequence; identical to SEQ ID NO: 3081
  Description of Artificial Sequence: Synthetic Light chain variable region nucleic acid sequence

SEQ ID NO: 3146 - protein, 112 aa, Artificial Sequence; identical to SEQ ID NO: 3082
  Description of Artificial Sequence: Synthetic Light chain variable region amino acid sequence

SEQ ID NO: 3147 - protein, 17 aa, Artificial Sequence
  Description of Artificial Sequence: Synthetic Light chain variable region CDR L1 amino acid sequence
KSSQSLLNSRTRKNYLA

SEQ ID NO: 3148 - DNA, 51 bp, Artificial Sequence; identical to SEQ ID NO: 2988
  Description of Artificial Sequence: Synthetic Light chain variable region CDR L1 nucleic acid sequence

SEQ ID NO: 3149 - protein, 7 aa, Artificial Sequence
  Description of Artificial Sequence: Synthetic Light chain variable region CDR L2 amino acid sequence
WASTRES

SEQ ID NO: 3150 - DNA, 21 bp, Artificial Sequence
  Description of Artificial Sequence: Synthetic Light chain variable region CDR L2 nucleic acid sequence
tgggcatctacccgggaatcc

SEQ ID NO: 3151 - protein, 8 aa, Artificial Sequence
  Description of Artificial Sequence: Synthetic Light chain variable region CDR L3 amino acid sequence
KQSYNLRT

SEQ ID NO: 3152 - DNA, 24 bp, Artificial Sequence
  Description of Artificial Sequence: Synthetic Light chain variable region CDR L3 nucleic acid sequence
aagcagagttacaatttgagaact

SEQ ID NO: 3153 - DNA, 351 bp, Artificial Sequence; identical to SEQ ID NO: 3057
  Description of Artificial Sequence: Synthetic Heavy chain variable region nucleic acid sequence

SEQ ID NO: 3154 - protein, 117 aa, Artificial Sequence; identical to SEQ ID NO: 3058
  Description of Artificial Sequence: Synthetic Heavy chain variable region amino acid sequence

SEQ ID NO: 3155 - protein, 9 aa, Artificial Sequence
  Description of Artificial Sequence: Synthetic Heavy chain variable region CDR H1 amino acid sequence
YTFTSYYIH

SEQ ID NO: 3156 - DNA, 27 bp, Artificial Sequence
  Description of Artificial Sequence: Synthetic Heavy chain variable region CDR H1 nucleic acid sequence
tacaccttcaccagctactatatacac

SEQ ID NO: 3157 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3158 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3159 - protein, 10 aa, Artificial Sequence
  Description of Artificial Sequence: Synthetic Heavy chain variable region CDR H3 amino acid sequence
ARDGSYYFDY

SEQ ID NO: 3160 - DNA, 30 bp, Artificial Sequence; identical to SEQ ID NO: 3064
  Description of Artificial Sequence: Synthetic Heavy chain variable region CDR H3 nucleic acid sequence

SEQ ID NO: 3161 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcagagttacaatttgagaactttcggcggagggaccaagctggagatcaaa

SEQ ID NO: 3162 - protein, 112 aa, Artificial Sequence
  Description of Artificial Sequence: Synthetic Light chain variable region amino acid sequence
DIVMTQSPDSLAVSLGERATINCKSSQSLLNSRTRKNYLAWYQQKPGQPPKLLIYWASTRESGVPDRFSGSGSGTDFTLTISSLQAEDVAVYYCKQSYNLRTFGGGTKLEIK

SEQ ID NO: 3163 - protein, 17 aa, Artificial Sequence
  Description of Artificial Sequence: Synthetic Light chain variable region CDR L1 amino acid sequence
KSSQSLLNSRTRKNYLA

SEQ ID NO: 3164 - DNA, 51 bp, Artificial Sequence; identical to SEQ ID NO: 2988
  Description of Artificial Sequence: Synthetic Light chain variable region CDR L1 nucleic acid sequence

SEQ ID NO: 3165 - protein, 7 aa, Artificial Sequence
  Description of Artificial Sequence: Synthetic Light chain variable region CDR L2 amino acid sequence
WASTRES

SEQ ID NO: 3166 - DNA, 21 bp, Artificial Sequence
  Description of Artificial Sequence: Synthetic Light chain variable region CDR L2 nucleic acid sequence
tgggcatctacccgggaatcc

SEQ ID NO: 3167 - protein, 8 aa, Artificial Sequence
  Description of Artificial Sequence: Synthetic Light chain variable region CDR L3 amino acid sequence
KQSYNLRT

SEQ ID NO: 3168 - DNA, 24 bp, Artificial Sequence
  Description of Artificial Sequence: Synthetic Light chain variable region CDR L3 nucleic acid sequence
aagcagagttacaatttgagaact

SEQ ID NO: 3169 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctcctatatacactgggtgcgacaggcccctggacaaaggcttgagtggatgggatggatctaccctggtaatgttaacacaaagtacaacgagaagttcaagggcagagtcaccataaccagggacacgtccgcgagcacagcctacatggagctgagcagcctgagatctgaggacacggcggtgtactactgcgctagggattatggctactactttgactactggggccaaggaaccctggtcaccgtctcctca

SEQ ID NO: 3170 - protein, 117 aa, Artificial Sequence
  Description of Artificial Sequence: Synthetic Heavy chain variable region amino acid sequence
QVQLVQSGAEVKKPGASVKVSCKASGYTFTSSYIHWVRQAPGQRLEWMGWIYPGNVNTKYNEKFKGRVTITRDTSASTAYMELSSLRSEDTAVYYCARDYGYYFDYWGQGTLVTVSS

SEQ ID NO: 3171 - protein, 9 aa, Artificial Sequence
  Description of Artificial Sequence: Synthetic Heavy chain variable region CDR H1 amino acid sequence
YTFTSSYIH

SEQ ID NO: 3172 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3173 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3174 - DNA, 51 bp, Artificial Sequence
  Description of Artificial Sequence: Synthetic Heavy chain variable region CDR H2 nucleic acid sequence
tggatctaccctggtaatgttaacacaaagtacaacgagaagttcaagggc

SEQ ID NO: 3175 - protein, 10 aa, Artificial Sequence
  Description of Artificial Sequence: Synthetic Heavy chain variable region CDR H3 amino acid sequence
ARDYGYYFDY

SEQ ID NO: 3176 - DNA, 30 bp, Artificial Sequence
  Description of Artificial Sequence: Synthetic Heavy chain variable region CDR H3 nucleic acid sequence
gctagggattatggctactactttgactac

SEQ ID NO: 3177 - DNA, 336 bp, Artificial Sequence; identical to SEQ ID NO: 2985
  Description of Artificial Sequence: Synthetic Light chain variable region nucleic acid sequence

SEQ ID NO: 3178 - protein, 112 aa, Artificial Sequence; identical to SEQ ID NO: 2986
  Description of Artificial Sequence: Synthetic Light chain variable region amino acid sequence

SEQ ID NO: 3179 - protein, 17 aa, Artificial Sequence
  Description of Artificial Sequence: Synthetic Light chain variable region CDR L1 amino acid sequence
KSSQSLLNSRTRKNYLA

SEQ ID NO: 3180 - DNA, 51 bp, Artificial Sequence; identical to SEQ ID NO: 2988
  Description of Artificial Sequence: Synthetic Light chain variable region CDR L1 nucleic acid sequence

SEQ ID NO: 3181 - protein, 7 aa, Artificial Sequence
  Description of Artificial Sequence: Synthetic Light chain variable region CDR L2 amino acid sequence
WASTRES

SEQ ID NO: 3182 - DNA, 21 bp, Artificial Sequence
  Description of Artificial Sequence: Synthetic Light chain variable region CDR L2 nucleic acid sequence
tgggcatctacccgggaatcc

SEQ ID NO: 3183 - protein, 8 aa, Artificial Sequence
  Description of Artificial Sequence: Synthetic Light chain variable region CDR L3 amino acid sequence
KQSYSLRT

SEQ ID NO: 3184 - DNA, 24 bp, Artificial Sequence
  Description of Artificial Sequence: Synthetic Light chain variable region CDR L3 nucleic acid sequence
aagcaatcttattctctgagaact

SEQ ID NO: 3185 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctcctatatacactgggtgcgacaggcccctggacaagggcttgagtggataggatggatctaccctggtaatgttaacacaaagtacaacgagaagttcaagggcagagccaccctgaccgcggacaagtccgcgagcacagcctacatgcacctgagcagcctgagatctgaggacacggcggtgtactactgcgcgagagactacggctactactttgactactggggccaaggaaccctggtcaccgtctcctca

SEQ ID NO: 3186 - protein, 117 aa, Artificial Sequence
  Description of Artificial Sequence: Synthetic Heavy chain variable region amino acid sequence
QVQLVQSGAEVKKPGASVKVSCKASGYTFTSSYIHWVRQAPGQGLEWIGWIYPGNVNTKYNEKFKGRATLTADKSASTAYMHLSSLRSEDTAVYYCARDYGYYFDYWGQGTLVTVSS

SEQ ID NO: 3187 - protein, 9 aa, Artificial Sequence
  Description of Artificial Sequence: Synthetic Heavy chain variable region CDR H1 amino acid sequence
YTFTSSYIH

SEQ ID NO: 3188 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3189 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3190 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3191 - protein, 10 aa, Artificial Sequence
  Description of Artificial Sequence: Synthetic Heavy chain variable region CDR H3 amino acid sequence
ARDYGYYFDY

SEQ ID NO: 3192 - DNA, 30 bp, Artificial Sequence
  Description of Artificial Sequence: Synthetic Heavy chain variable region CDR H3 nucleic acid sequence
gcgagagactacggctactactttgactac

SEQ ID NO: 3193 - DNA, 336 bp, Artificial Sequence; identical to SEQ ID NO: 2985
  Description of Artificial Sequence: Synthetic Light chain variable region nucleic acid sequence

SEQ ID NO: 3194 - protein, 112 aa, Artificial Sequence; identical to SEQ ID NO: 2986
  Description of Artificial Sequence: Synthetic Light chain variable region amino acid sequence

SEQ ID NO: 3195 - protein, 17 aa, Artificial Sequence
  Description of Artificial Sequence: Synthetic Light chain variable region CDR L1 amino acid sequence
KSSQSLLNSRTRKNYLA

SEQ ID NO: 3196 - DNA, 51 bp, Artificial Sequence; identical to SEQ ID NO: 2988
  Description of Artificial Sequence: Synthetic Light chain variable region CDR L1 nucleic acid sequence

SEQ ID NO: 3197 - protein, 7 aa, Artificial Sequence
  Description of Artificial Sequence: Synthetic Light chain variable region CDR L2 amino acid sequence
WASTRES

SEQ ID NO: 3198 - DNA, 21 bp, Artificial Sequence
  Description of Artificial Sequence: Synthetic Light chain variable region CDR L2 nucleic acid sequence
tgggcatctacccgggaatcc

SEQ ID NO: 3199 - protein, 8 aa, Artificial Sequence
  Description of Artificial Sequence: Synthetic Light chain variable region CDR L3 amino acid sequence
KQSYSLRT

SEQ ID NO: 3200 - DNA, 24 bp, Artificial Sequence
  Description of Artificial Sequence: Synthetic Light chain variable region CDR L3 nucleic acid sequence
aagcaatcttattctctgagaact

SEQ ID NO: 3201 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctcctatatacactgggtgcgacaggcccctggacaaaggcttgagtggataggatggatctaccctggtaatgttaacacaaagtacaacgagaagttcaagggcagagtcaccataaccgcggacaagtccgcgagcacagcctacatggagctgagcagcctgagatctgaggacacggcggtgtactactgcgcgagggattacggatactactttgactactggggccaaggaaccctggtcaccgtctcctca

SEQ ID NO: 3202 - protein, 117 aa, Artificial Sequence
  Description of Artificial Sequence: Synthetic Heavy chain variable region amino acid sequence
QVQLVQSGAEVKKPGASVKVSCKASGYTFTSSYIHWVRQAPGQRLEWIGWIYPGNVNTKYNEKFKGRVTITADKSASTAYMELSSLRSEDTAVYYCARDYGYYFDYWGQGTLVTVSS

SEQ ID NO: 3203 - protein, 9 aa, Artificial Sequence
  Description of Artificial Sequence: Synthetic Heavy chain variable region CDR H1 amino acid sequence
YTFTSSYIH

SEQ ID NO: 3204 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3205 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3206 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3207 - protein, 10 aa, Artificial Sequence
  Description of Artificial Sequence: Synthetic Heavy chain variable region CDR H3 amino acid sequence
ARDYGYYFDY

SEQ ID NO: 3208 - DNA, 30 bp, Artificial Sequence
  Description of Artificial Sequence: Synthetic Heavy chain variable region CDR H3 nucleic acid sequence
gcgagggattacggatactactttgactac

SEQ ID NO: 3209 - DNA, 336 bp, Artificial Sequence; identical to SEQ ID NO: 2985
  Description of Artificial Sequence: Synthetic Light chain variable region nucleic acid sequence

SEQ ID NO: 3210 - protein, 112 aa, Artificial Sequence; identical to SEQ ID NO: 2986
  Description of Artificial Sequence: Synthetic Light chain variable region amino acid sequence

SEQ ID NO: 3211 - protein, 17 aa, Artificial Sequence
  Description of Artificial Sequence: Synthetic Light chain variable region CDR L1 amino acid sequence
KSSQSLLNSRTRKNYLA

SEQ ID NO: 3212 - DNA, 51 bp, Artificial Sequence; identical to SEQ ID NO: 2988
  Description of Artificial Sequence: Synthetic Light chain variable region CDR L1 nucleic acid sequence

SEQ ID NO: 3213 - protein, 7 aa, Artificial Sequence
  Description of Artificial Sequence: Synthetic Light chain variable region CDR L2 amino acid sequence
WASTRES

SEQ ID NO: 3214 - DNA, 21 bp, Artificial Sequence
  Description of Artificial Sequence: Synthetic Light chain variable region CDR L2 nucleic acid sequence
tgggcatctacccgggaatcc

SEQ ID NO: 3215 - protein, 8 aa, Artificial Sequence
  Description of Artificial Sequence: Synthetic Light chain variable region CDR L3 amino acid sequence
KQSYSLRT

SEQ ID NO: 3216 - DNA, 24 bp, Artificial Sequence
  Description of Artificial Sequence: Synthetic Light chain variable region CDR L3 nucleic acid sequence
aagcaatcttattctctgagaact

SEQ ID NO: 3217 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctcctatatacactgggtgcgacaggcccctggacaagggcttgagtggatgggatggatctaccctggtaatgttaacacaaagtacaacgagaagttcaagggcagagtcaccatgaccagggacacgtccacgagcacagtctacatggagctgagcagcctgagatctgaggacacggcggtgtactactgcgctagggactatggttactactttgactactggggccaaggaaccctggtcaccgtctcctca

SEQ ID NO: 3218 - protein, 117 aa, Artificial Sequence
  Description of Artificial Sequence: Synthetic Heavy chain variable region amino acid sequence
QVQLVQSGAEVKKPGASVKVSCKASGYTFTSSYIHWVRQAPGQGLEWMGWIYPGNVNTKYNEKFKGRVTMTRDTSTSTVYMELSSLRSEDTAVYYCARDYGYYFDYWGQGTLVTVSS

SEQ ID NO: 3219 - protein, 9 aa, Artificial Sequence
  Description of Artificial Sequence: Synthetic Heavy chain variable region CDR H1 amino acid sequence
YTFTSSYIH

SEQ ID NO: 3220 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3221 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3222 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3223 - protein, 10 aa, Artificial Sequence
  Description of Artificial Sequence: Synthetic Heavy chain variable region CDR H3 amino acid sequence
ARDYGYYFDY

SEQ ID NO: 3224 - DNA, 30 bp, Artificial Sequence
  Description of Artificial Sequence: Synthetic Heavy chain variable region CDR H3 nucleic acid sequence
gctagggactatggttactactttgactac

SEQ ID NO: 3225 - DNA, 336 bp, Artificial Sequence; identical to SEQ ID NO: 2985
  Description of Artificial Sequence: Synthetic Light chain variable region nucleic acid sequence

SEQ ID NO: 3226 - protein, 112 aa, Artificial Sequence; identical to SEQ ID NO: 2986
  Description of Artificial Sequence: Synthetic Light chain variable region amino acid sequence

SEQ ID NO: 3227 - protein, 17 aa, Artificial Sequence
  Description of Artificial Sequence: Synthetic Light chain variable region CDR L1 amino acid sequence
KSSQSLLNSRTRKNYLA

SEQ ID NO: 3228 - DNA, 51 bp, Artificial Sequence; identical to SEQ ID NO: 2988
  Description of Artificial Sequence: Synthetic Light chain variable region CDR L1 nucleic acid sequence

SEQ ID NO: 3229 - protein, 7 aa, Artificial Sequence
  Description of Artificial Sequence: Synthetic Light chain variable region CDR L2 amino acid sequence
WASTRES

SEQ ID NO: 3230 - DNA, 21 bp, Artificial Sequence
  Description of Artificial Sequence: Synthetic Light chain variable region CDR L2 nucleic acid sequence
tgggcatctacccgggaatcc

SEQ ID NO: 3231 - protein, 8 aa, Artificial Sequence
  Description of Artificial Sequence: Synthetic Light chain variable region CDR L3 amino acid sequence
KQSYSLRT

SEQ ID NO: 3232 - DNA, 24 bp, Artificial Sequence
  Description of Artificial Sequence: Synthetic Light chain variable region CDR L3 nucleic acid sequence
aagcaatcttattctctgagaact

SEQ ID NO: 3233 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctcctatatacactgggtgcgacaggcccctggacaagggcttgagtggataggatggatctaccctggtaatgttaacacaaagtacaacgagaagttcaagggcagagtcaccatgaccgcggacaagtccacgagcacagcctacatggagctgagcagcctgagatctgaggacacggcggtgtactactgcgctagggactacggttattactttgactactggggccaaggaaccctggtcaccgtctcctca

SEQ ID NO: 3234 - protein, 117 aa, Artificial Sequence
  Description of Artificial Sequence: Synthetic Heavy chain variable region amino acid sequence
QVQLVQSGAEVKKPGASVKVSCKASGYTFTSSYIHWVRQAPGQGLEWIGWIYPGNVNTKYNEKFKGRVTMTADKSTSTAYMELSSLRSEDTAVYYCARDYGYYFDYWGQGTLVTVSS

SEQ ID NO: 3235 - protein, 9 aa, Artificial Sequence
  Description of Artificial Sequence: Synthetic Heavy chain variable region CDR H1 amino acid sequence
YTFTSSYIH

SEQ ID NO: 3236 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3237 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3238 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3239 - protein, 10 aa, Artificial Sequence
  Description of Artificial Sequence: Synthetic Heavy chain variable region CDR H3 amino acid sequence
ARDYGYYFDY

SEQ ID NO: 3240 - DNA, 30 bp, Artificial Sequence
  Description of Artificial Sequence: Synthetic Heavy chain variable region CDR H3 nucleic acid sequence
gctagggactacggttattactttgactac

SEQ ID NO: 3241 - DNA, 336 bp, Artificial Sequence; identical to SEQ ID NO: 2985
  Description of Artificial Sequence: Synthetic Light chain variable region nucleic acid sequence

SEQ ID NO: 3242 - protein, 112 aa, Artificial Sequence; identical to SEQ ID NO: 2986
  Description of Artificial Sequence: Synthetic Light chain variable region amino acid sequence

SEQ ID NO: 3243 - protein, 17 aa, Artificial Sequence
  Description of Artificial Sequence: Synthetic Light chain variable region CDR L1 amino acid sequence
KSSQSLLNSRTRKNYLA

SEQ ID NO: 3244 - DNA, 51 bp, Artificial Sequence; identical to SEQ ID NO: 2988
  Description of Artificial Sequence: Synthetic Light chain variable region CDR L1 nucleic acid sequence

SEQ ID NO: 3245 - protein, 7 aa, Artificial Sequence
  Description of Artificial Sequence: Synthetic Light chain variable region CDR L2 amino acid sequence
WASTRES

SEQ ID NO: 3246 - DNA, 21 bp, Artificial Sequence
  Description of Artificial Sequence: Synthetic Light chain variable region CDR L2 nucleic acid sequence
tgggcatctacccgggaatcc

SEQ ID NO: 3247 - protein, 8 aa, Artificial Sequence
  Description of Artificial Sequence: Synthetic Light chain variable region CDR L3 amino acid sequence
KQSYSLRT

SEQ ID NO: 3248 - DNA, 24 bp, Artificial Sequence
  Description of Artificial Sequence: Synthetic Light chain variable region CDR L3 nucleic acid sequence
aagcaatcttattctctgagaact

SEQ ID NO: 3249 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctcctatatacactgggtgcgacaggcccctggacaagggcttgagtggataggatggatctaccctggtaatgttaacacaaagtacaacgagaagttcaagggcagagccaccctgaccgcggacaagtccacgagcacagcctacatgcacctgagcagcctgagatctgaggacacggcggtgtactactgcgcgagggactatggctactactttgactactggggccaaggaaccctggtcaccgtctcctca

SEQ ID NO: 3250 - protein, 117 aa, Artificial Sequence
  Description of Artificial Sequence: Synthetic Heavy chain variable region amino acid sequence
QVQLVQSGAEVKKPGASVKVSCKASGYTFTSSYIHWVRQAPGQGLEWIGWIYPGNVNTKYNEKFKGRATLTADKSTSTAYMHLSSLRSEDTAVYYCARDYGYYFDYWGQGTLVTVSS

SEQ ID NO: 3251 - protein, 9 aa, Artificial Sequence
  Description of Artificial Sequence: Synthetic Heavy chain variable region CDR H1 amino acid sequence
YTFTSSYIH

SEQ ID NO: 3252 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3253 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3254 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3255 - protein, 10 aa, Artificial Sequence
  Description of Artificial Sequence: Synthetic Heavy chain variable region CDR H3 amino acid sequence
ARDYGYYFDY

SEQ ID NO: 3256 - DNA, 30 bp, Artificial Sequence
  Description of Artificial Sequence: Synthetic Heavy chain variable region CDR H3 nucleic acid sequence
gcgagggactatggctactactttgactac

SEQ ID NO: 3257 - DNA, 336 bp, Artificial Sequence; identical to SEQ ID NO: 2985
  Description of Artificial Sequence: Synthetic Light chain variable region nucleic acid sequence

SEQ ID NO: 3258 - protein, 112 aa, Artificial Sequence; identical to SEQ ID NO: 2986
  Description of Artificial Sequence: Synthetic Light chain variable region amino acid sequence

SEQ ID NO: 3259 - protein, 17 aa, Artificial Sequence
  Description of Artificial Sequence: Synthetic Light chain variable region CDR L1 amino acid sequence
KSSQSLLNSRTRKNYLA

SEQ ID NO: 3260 - DNA, 51 bp, Artificial Sequence; identical to SEQ ID NO: 2988
  Description of Artificial Sequence: Synthetic Light chain variable region CDR L1 nucleic acid sequence

SEQ ID NO: 3261 - protein, 7 aa, Artificial Sequence
  Description of Artificial Sequence: Synthetic Light chain variable region CDR L2 amino acid sequence
WASTRES

SEQ ID NO: 3262 - DNA, 21 bp, Artificial Sequence
  Description of Artificial Sequence: Synthetic Light chain variable region CDR L2 nucleic acid sequence
tgggcatctacccgggaatcc

SEQ ID NO: 3263 - protein, 8 aa, Artificial Sequence
  Description of Artificial Sequence: Synthetic Light chain variable region CDR L3 amino acid sequence
KQSYSLRT

SEQ ID NO: 3264 - DNA, 24 bp, Artificial Sequence
  Description of Artificial Sequence: Synthetic Light chain variable region CDR L3 nucleic acid sequence
aagcaatcttattctctgagaact

SEQ ID NO: 3265 - DNA, 351 bp, Artificial Sequence; identical to SEQ ID NO: 3169
  Description of Artificial Sequence: Synthetic Heavy chain variable region nucleic acid sequence

SEQ ID NO: 3266 - protein, 117 aa, Artificial Sequence; identical to SEQ ID NO: 3170
  Description of Artificial Sequence: Synthetic Heavy chain variable region amino acid sequence

SEQ ID NO: 3267 - protein, 9 aa, Artificial Sequence
  Description of Artificial Sequence: Synthetic Heavy chain variable region CDR H1 amino acid sequence
YTFTSSYIH

SEQ ID NO: 3268 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3269 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3270 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3271 - protein, 10 aa, Artificial Sequence
  Description of Artificial Sequence: Synthetic Heavy chain variable region CDR H3 amino acid sequence
ARDYGYYFDY

SEQ ID NO: 3272 - DNA, 30 bp, Artificial Sequence; identical to SEQ ID NO: 3176
  Description of Artificial Sequence: Synthetic Heavy chain variable region CDR H3 nucleic acid sequence

SEQ ID NO: 3273 - DNA, 336 bp, Artificial Sequence; identical to SEQ ID NO: 3081
  Description of Artificial Sequence: Synthetic Light chain variable region nucleic acid sequence

SEQ ID NO: 3274 - protein, 112 aa, Artificial Sequence; identical to SEQ ID NO: 3082
  Description of Artificial Sequence: Synthetic Light chain variable region amino acid sequence

SEQ ID NO: 3275 - protein, 17 aa, Artificial Sequence
  Description of Artificial Sequence: Synthetic Light chain variable region CDR L1 amino acid sequence
KSSQSLLNSRTRKNYLA

SEQ ID NO: 3276 - DNA, 51 bp, Artificial Sequence; identical to SEQ ID NO: 2988
  Description of Artificial Sequence: Synthetic Light chain variable region CDR L1 nucleic acid sequence

SEQ ID NO: 3277 - protein, 7 aa, Artificial Sequence
  Description of Artificial Sequence: Synthetic Light chain variable region CDR L2 amino acid sequence
WASTRES

SEQ ID NO: 3278 - DNA, 21 bp, Artificial Sequence
  Description of Artificial Sequence: Synthetic Light chain variable region CDR L2 nucleic acid sequence
tgggcatctacccgggaatcc

SEQ ID NO: 3279 - protein, 8 aa, Artificial Sequence
  Description of Artificial Sequence: Synthetic Light chain variable region CDR L3 amino acid sequence
KQSYNLRT

SEQ ID NO: 3280 - DNA, 24 bp, Artificial Sequence
  Description of Artificial Sequence: Synthetic Light chain variable region CDR L3 nucleic acid sequence
aagcagagttacaatttgagaact

SEQ ID NO: 3281 - DNA, 351 bp, Artificial Sequence; identical to SEQ ID NO: 3185
  Description of Artificial Sequence: Synthetic Heavy chain variable region nucleic acid sequence

SEQ ID NO: 3282 - protein, 117 aa, Artificial Sequence; identical to SEQ ID NO: 3186
  Description of Artificial Sequence: Synthetic Heavy chain variable region amino acid sequence

SEQ ID NO: 3283 - protein, 9 aa, Artificial Sequence
  Description of Artificial Sequence: Synthetic Heavy chain variable region CDR H1 amino acid sequence
YTFTSSYIH

SEQ ID NO: 3284 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3285 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3286 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3287 - protein, 10 aa, Artificial Sequence
  Description of Artificial Sequence: Synthetic Heavy chain variable region CDR H3 amino acid sequence
ARDYGYYFDY

SEQ ID NO: 3288 - DNA, 30 bp, Artificial Sequence; identical to SEQ ID NO: 3192
  Description of Artificial Sequence: Synthetic Heavy chain variable region CDR H3 nucleic acid sequence

SEQ ID NO: 3289 - DNA, 336 bp, Artificial Sequence; identical to SEQ ID NO: 3081
  Description of Artificial Sequence: Synthetic Light chain variable region nucleic acid sequence

SEQ ID NO: 3290 - protein, 112 aa, Artificial Sequence; identical to SEQ ID NO: 3082
  Description of Artificial Sequence: Synthetic Light chain variable region amino acid sequence

SEQ ID NO: 3291 - protein, 17 aa, Artificial Sequence
  Description of Artificial Sequence: Synthetic Light chain variable region CDR L1 amino acid sequence
KSSQSLLNSRTRKNYLA

SEQ ID NO: 3292 - DNA, 51 bp, Artificial Sequence; identical to SEQ ID NO: 2988
  Description of Artificial Sequence: Synthetic Light chain variable region CDR L1 nucleic acid sequence

SEQ ID NO: 3293 - protein, 7 aa, Artificial Sequence
  Description of Artificial Sequence: Synthetic Light chain variable region CDR L2 amino acid sequence
WASTRES

SEQ ID NO: 3294 - DNA, 21 bp, Artificial Sequence
  Description of Artificial Sequence: Synthetic Light chain variable region CDR L2 nucleic acid sequence
tgggcatctacccgggaatcc

SEQ ID NO: 3295 - protein, 8 aa, Artificial Sequence
  Description of Artificial Sequence: Synthetic Light chain variable region CDR L3 amino acid sequence
KQSYNLRT

SEQ ID NO: 3296 - DNA, 24 bp, Artificial Sequence
  Description of Artificial Sequence: Synthetic Light chain variable region CDR L3 nucleic acid sequence
aagcagagttacaatttgagaact

SEQ ID NO: 3297 - DNA, 351 bp, Artificial Sequence; identical to SEQ ID NO: 3201
  Description of Artificial Sequence: Synthetic Heavy chain variable region nucleic acid sequence

SEQ ID NO: 3298 - protein, 117 aa, Artificial Sequence; identical to SEQ ID NO: 3202
  Description of Artificial Sequence: Synthetic Heavy chain variable region amino acid sequence

SEQ ID NO: 3299 - protein, 9 aa, Artificial Sequence
  Description of Artificial Sequence: Synthetic Heavy chain variable region CDR H1 amino acid sequence
YTFTSSYIH

SEQ ID NO: 3300 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3301 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3302 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3303 - protein, 10 aa, Artificial Sequence
  Description of Artificial Sequence: Synthetic Heavy chain variable region CDR H3 amino acid sequence
ARDYGYYFDY

SEQ ID NO: 3304 - DNA, 30 bp, Artificial Sequence; identical to SEQ ID NO: 3208
  Description of Artificial Sequence: Synthetic Heavy chain variable region CDR H3 nucleic acid sequence

SEQ ID NO: 3305 - DNA, 336 bp, Artificial Sequence; identical to SEQ ID NO: 3081
  Description of Artificial Sequence: Synthetic Light chain variable region nucleic acid sequence

SEQ ID NO: 3306 - protein, 112 aa, Artificial Sequence; identical to SEQ ID NO: 3082
  Description of Artificial Sequence: Synthetic Light chain variable region amino acid sequence

SEQ ID NO: 3307 - protein, 17 aa, Artificial Sequence
  Description of Artificial Sequence: Synthetic Light chain variable region CDR L1 amino acid sequence
KSSQSLLNSRTRKNYLA

SEQ ID NO: 3308 - DNA, 51 bp, Artificial Sequence; identical to SEQ ID NO: 2988
  Description of Artificial Sequence: Synthetic Light chain variable region CDR L1 nucleic acid sequence

SEQ ID NO: 3309 - protein, 7 aa, Artificial Sequence
  Description of Artificial Sequence: Synthetic Light chain variable region CDR L2 amino acid sequence
WASTRES

SEQ ID NO: 3310 - DNA, 21 bp, Artificial Sequence
  Description of Artificial Sequence: Synthetic Light chain variable region CDR L2 nucleic acid sequence
tgggcatctacccgggaatcc

SEQ ID NO: 3311 - protein, 8 aa, Artificial Sequence
  Description of Artificial Sequence: Synthetic Light chain variable region CDR L3 amino acid sequence
KQSYNLRT

SEQ ID NO: 3312 - DNA, 24 bp, Artificial Sequence
  Description of Artificial Sequence: Synthetic Light chain variable region CDR L3 nucleic acid sequence
aagcagagttacaatttgagaact

SEQ ID NO: 3313 - DNA, 351 bp, Artificial Sequence; identical to SEQ ID NO: 3217
  Description of Artificial Sequence: Synthetic Heavy chain variable region nucleic acid sequence

SEQ ID NO: 3314 - protein, 117 aa, Artificial Sequence; identical to SEQ ID NO: 3218
  Description of Artificial Sequence: Synthetic Heavy chain variable region amino acid sequence

SEQ ID NO: 3315 - protein, 9 aa, Artificial Sequence
  Description of Artificial Sequence: Synthetic Heavy chain variable region CDR H1 amino acid sequence
YTFTSSYIH

SEQ ID NO: 3316 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3317 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3318 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3319 - protein, 10 aa, Artificial Sequence
  Description of Artificial Sequence: Synthetic Heavy chain variable region CDR H3 amino acid sequence
ARDYGYYFDY

SEQ ID NO: 3320 - DNA, 30 bp, Artificial Sequence; identical to SEQ ID NO: 3224
  Description of Artificial Sequence: Synthetic Heavy chain variable region CDR H3 nucleic acid sequence

SEQ ID NO: 3321 - DNA, 336 bp, Artificial Sequence; identical to SEQ ID NO: 3081
  Description of Artificial Sequence: Synthetic Light chain variable region nucleic acid sequence

SEQ ID NO: 3322 - protein, 112 aa, Artificial Sequence; identical to SEQ ID NO: 3082
  Description of Artificial Sequence: Synthetic Light chain variable region amino acid sequence

SEQ ID NO: 3323 - protein, 17 aa, Artificial Sequence
  Description of Artificial Sequence: Synthetic Light chain variable region CDR L1 amino acid sequence
KSSQSLLNSRTRKNYLA

SEQ ID NO: 3324 - DNA, 51 bp, Artificial Sequence; identical to SEQ ID NO: 2988
  Description of Artificial Sequence: Synthetic Light chain variable region CDR L1 nucleic acid sequence

SEQ ID NO: 3325 - protein, 7 aa, Artificial Sequence
  Description of Artificial Sequence: Synthetic Light chain variable region CDR L2 amino acid sequence
WASTRES

SEQ ID NO: 3326 - DNA, 21 bp, Artificial Sequence
  Description of Artificial Sequence: Synthetic Light chain variable region CDR L2 nucleic acid sequence
tgggcatctacccgggaatcc

SEQ ID NO: 3327 - protein, 8 aa, Artificial Sequence
  Description of Artificial Sequence: Synthetic Light chain variable region CDR L3 amino acid sequence
KQSYNLRT

SEQ ID NO: 3328 - DNA, 24 bp, Artificial Sequence
  Description of Artificial Sequence: Synthetic Light chain variable region CDR L3 nucleic acid sequence
aagcagagttacaatttgagaact

SEQ ID NO: 3329 - DNA, 351 bp, Artificial Sequence; identical to SEQ ID NO: 3233
  Description of Artificial Sequence: Synthetic Heavy chain variable region nucleic acid sequence

SEQ ID NO: 3330 - protein, 117 aa, Artificial Sequence; identical to SEQ ID NO: 3234
  Description of Artificial Sequence: Synthetic Heavy chain variable region amino acid sequence

SEQ ID NO: 3331 - protein, 9 aa, Artificial Sequence
  Description of Artificial Sequence: Synthetic Heavy chain variable region CDR H1 amino acid sequence
YTFTSSYIH

SEQ ID NO: 3332 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3333 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3334 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3335 - protein, 10 aa, Artificial Sequence
  Description of Artificial Sequence: Synthetic Heavy chain variable region CDR H3 amino acid sequence
ARDYGYYFDY

SEQ ID NO: 3336 - DNA, 30 bp, Artificial Sequence; identical to SEQ ID NO: 3240
  Description of Artificial Sequence: Synthetic Heavy chain variable region CDR H3 nucleic acid sequence

SEQ ID NO: 3337 - DNA, 336 bp, Artificial Sequence
  Description of Artificial Sequence: Synthetic Light chain variable region nucleic acid sequence
gacatcgtgatgacccagtctccagactccctggctgtgtctctaggcgagagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcagagttacaatttgagaactttcggcggagggaccaaggtggagatcaaa

SEQ ID NO: 3338 - protein, 112 aa, Artificial Sequence; identical to SEQ ID NO: 3082
  Description of Artificial Sequence: Synthetic Light chain variable region amino acid sequence

SEQ ID NO: 3339 - protein, 17 aa, Artificial Sequence
  Description of Artificial Sequence: Synthetic Light chain variable region CDR L1 amino acid sequence
KSSQSLLNSRTRKNYLA

SEQ ID NO: 3340 - DNA, 51 bp, Artificial Sequence; identical to SEQ ID NO: 2988
  Description of Artificial Sequence: Synthetic Light chain variable region CDR L1 nucleic acid sequence

SEQ ID NO: 3341 - protein, 7 aa, Artificial Sequence
  Description of Artificial Sequence: Synthetic Light chain variable region CDR L2 amino acid sequence
WASTRES

SEQ ID NO: 3342 - DNA, 21 bp, Artificial Sequence
  Description of Artificial Sequence: Synthetic Light chain variable region CDR L2 nucleic acid sequence
tgggcatctacccgggaatcc

SEQ ID NO: 3343 - protein, 8 aa, Artificial Sequence
  Description of Artificial Sequence: Synthetic Light chain variable region CDR L3 amino acid sequence
KQSYNLRT

SEQ ID NO: 3344 - DNA, 24 bp, Artificial Sequence
  Description of Artificial Sequence: Synthetic Light chain variable region CDR L3 nucleic acid sequence
aagcagagttacaatttgagaact

SEQ ID NO: 3345 - DNA, 351 bp, Artificial Sequence; identical to SEQ ID NO: 3249
  Description of Artificial Sequence: Synthetic Heavy chain variable region nucleic acid sequence

SEQ ID NO: 3346 - protein, 117 aa, Artificial Sequence; identical to SEQ ID NO: 3250
  Description of Artificial Sequence: Synthetic Heavy chain variable region amino acid sequence

SEQ ID NO: 3347 - protein, 9 aa, Artificial Sequence
  Description of Artificial Sequence: Synthetic Heavy chain variable region CDR H1 amino acid sequence
YTFTSSYIH

SEQ ID NO: 3348 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3349 - protein, 17 aa, Artificial Sequence
  Description of Artificial Sequence: Synthetic Heavy chain variable region CDR H2 amino acid sequence
WIYPGNVNTKYNEKFKG

SEQ ID NO: 3350 - DNA, 51 bp, Artificial Sequence; identical to SEQ ID NO: 3174
  Description of Artificial Sequence: Synthetic Heavy chain variable region CDR H2 nucleic acid sequence

SEQ ID NO: 3351 - protein, 10 aa, Artificial Sequence
  Description of Artificial Sequence: Synthetic Heavy chain variable region CDR H3 amino acid sequence
ARDYGYYFDY

SEQ ID NO: 3352 - DNA, 30 bp, Artificial Sequence; identical to SEQ ID NO: 3256
  Description of Artificial Sequence: Synthetic Heavy chain variable region CDR H3 nucleic acid sequence

SEQ ID NO: 3353 - DNA, 336 bp, Artificial Sequence; identical to SEQ ID NO: 3081
  Description of Artificial Sequence: Synthetic Light chain variable region nucleic acid sequence

SEQ ID NO: 3354 - protein, 112 aa, Artificial Sequence; identical to SEQ ID NO: 3082
  Description of Artificial Sequence: Synthetic Light chain variable region amino acid sequence

SEQ ID NO: 3355 - protein, 17 aa, Artificial Sequence
  Description of Artificial Sequence: Synthetic Light chain variable region CDR L1 amino acid sequence
KSSQSLLNSRTRKNYLA

SEQ ID NO: 3356 - DNA, 51 bp, Artificial Sequence; identical to SEQ ID NO: 2988
  Description of Artificial Sequence: Synthetic Light chain variable region CDR L1 nucleic acid sequence

SEQ ID NO: 3357 - protein, 7 aa, Artificial Sequence
  Description of Artificial Sequence: Synthetic Light chain variable region CDR L2 amino acid sequence
WASTRES

SEQ ID NO: 3358 - DNA, 21 bp, Artificial Sequence
  Description of Artificial Sequence: Synthetic Light chain variable region CDR L2 nucleic acid sequence
tgggcatctacccgggaatcc

SEQ ID NO: 3359 - protein, 8 aa, Artificial Sequence
  Description of Artificial Sequence: Synthetic Light chain variable region CDR L3 amino acid sequence
KQSYNLRT

SEQ ID NO: 3360 - DNA, 24 bp, Artificial Sequence
  Description of Artificial Sequence: Synthetic Light chain variable region CDR L3 nucleic acid sequence
aagcagagttacaatttgagaact

SEQ ID NO: 3361 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggattcaacatcaaggactactatatgcactgggtgcgacaggcccctggacaagggcttgagtggatgggatggatcgaccctgaaaatggtaacacaatctacgacccgaagttccagggcagagtcaccatgaccagggacacgtccacgagcacagtctacatggagctgagcagcctgagatctgaggacacggcggtgtactactgcgctagagacggatatgcaaggtattactttgactactggggccaaggaaccctggtcaccgtctcctca

SEQ ID NO: 3362 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQGLEWMGWIDPENGNTIYDPKFQGRVTMTRDTSTSTVYMELSSLRSEDTAVYYCARDGYARYYFDYWGQGTLVTVSS

SEQ ID NO: 3363 - protein, 9 aa, Artificial Sequence
  Description of Artificial Sequence: Synthetic Heavy chain variable region CDR H1 amino acid sequence
FNIKDYYMH

SEQ ID NO: 3364 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3365 - protein, 17 aa, Artificial Sequence
  Description of Artificial Sequence: Synthetic Heavy chain variable region CDR H2 amino acid sequence
WIDPENGNTIYDPKFQG

SEQ ID NO: 3366 - DNA, 51 bp, Artificial Sequence
  Description of Artificial Sequence: Synthetic Heavy chain variable region CDR H2 nucleic acid sequence
tggatcgaccctgaaaatggtaacacaatctacgacccgaagttccagggc

SEQ ID NO: 3367 - protein, 12 aa, Artificial Sequence
  Description of Artificial Sequence: Synthetic Heavy chain variable region CDR H3 amino acid sequence
ARDGYARYYFDY

SEQ ID NO: 3368 - DNA, 36 bp, Artificial Sequence
  Description of Artificial Sequence: Synthetic Heavy chain variable region CDR H3 nucleic acid sequence
gctagagacggatatgcaaggtattactttgactac

SEQ ID NO: 3369 - DNA, 336 bp, Artificial Sequence; identical to SEQ ID NO: 2985
  Description of Artificial Sequence: Synthetic Light chain variable region nucleic acid sequence

SEQ ID NO: 3370 - protein, 112 aa, Artificial Sequence; identical to SEQ ID NO: 2986
  Description of Artificial Sequence: Synthetic Light chain variable region amino acid sequence

SEQ ID NO: 3371 - protein, 17 aa, Artificial Sequence
  Description of Artificial Sequence: Synthetic Light chain variable region CDR L1 amino acid sequence
KSSQSLLNSRTRKNYLA

SEQ ID NO: 3372 - DNA, 51 bp, Artificial Sequence; identical to SEQ ID NO: 2988
  Description of Artificial Sequence: Synthetic Light chain variable region CDR L1 nucleic acid sequence

SEQ ID NO: 3373 - protein, 7 aa, Artificial Sequence
  Description of Artificial Sequence: Synthetic Light chain variable region CDR L2 amino acid sequence
WASTRES

SEQ ID NO: 3374 - DNA, 21 bp, Artificial Sequence
  Description of Artificial Sequence: Synthetic Light chain variable region CDR L2 nucleic acid sequence
tgggcatctacccgggaatcc

SEQ ID NO: 3375 - protein, 8 aa, Artificial Sequence
  Description of Artificial Sequence: Synthetic Light chain variable region CDR L3 amino acid sequence
KQSYSLRT

SEQ ID NO: 3376 - DNA, 24 bp, Artificial Sequence
  Description of Artificial Sequence: Synthetic Light chain variable region CDR L3 nucleic acid sequence
aagcaatcttattctctgagaact

SEQ ID NO: 3377 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggattcaacatcaaggactactatatgcactgggtgcgacaggcccctggacaagggcttgagtggataggatggatcgaccctgaaaatggtaacacaatctacgacccgaagttccagggcagagtcaccatgaccgcggacacgtccacgagcacagcctacatggagctgagcagcctgagatctgaggacacggcggtgtactactgcgcgagggacggttatgctagatattactttgactactggggccaaggaaccctggtcaccgtctcctca

SEQ ID NO: 3378 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQGLEWIGWIDPENGNTIYDPKFQGRVTMTADTSTSTAYMELSSLRSEDTAVYYCARDGYARYYFDYWGQGTLVTVSS

SEQ ID NO: 3379 - protein, 9 aa, Artificial Sequence
  Description of Artificial Sequence: Synthetic Heavy chain variable region CDR H1 amino acid sequence
FNIKDYYMH

SEQ ID NO: 3380 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3381 - protein, 17 aa, Artificial Sequence
  Description of Artificial Sequence: Synthetic Heavy chain variable region CDR H2 amino acid sequence
WIDPENGNTIYDPKFQG

SEQ ID NO: 3382 - DNA, 51 bp, Artificial Sequence; identical to SEQ ID NO: 3366
  Description of Artificial Sequence: Synthetic Heavy chain variable region CDR H2 nucleic acid sequence

SEQ ID NO: 3383 - protein, 12 aa, Artificial Sequence
  Description of Artificial Sequence: Synthetic Heavy chain variable region CDR H3 amino acid sequence
ARDGYARYYFDY

SEQ ID NO: 3384 - DNA, 36 bp, Artificial Sequence
  Description of Artificial Sequence: Synthetic Heavy chain variable region CDR H3 nucleic acid sequence
gcgagggacggttatgctagatattactttgactac

SEQ ID NO: 3385 - DNA, 336 bp, Artificial Sequence; identical to SEQ ID NO: 2985
  Description of Artificial Sequence: Synthetic Light chain variable region nucleic acid sequence

SEQ ID NO: 3386 - protein, 112 aa, Artificial Sequence; identical to SEQ ID NO: 2986
  Description of Artificial Sequence: Synthetic Light chain variable region amino acid sequence

SEQ ID NO: 3387 - protein, 17 aa, Artificial Sequence
  Description of Artificial Sequence: Synthetic Light chain variable region CDR L1 amino acid sequence
KSSQSLLNSRTRKNYLA

SEQ ID NO: 3388 - DNA, 51 bp, Artificial Sequence; identical to SEQ ID NO: 2988
  Description of Artificial Sequence: Synthetic Light chain variable region CDR L1 nucleic acid sequence

SEQ ID NO: 3389 - protein, 7 aa, Artificial Sequence
  Description of Artificial Sequence: Synthetic Light chain variable region CDR L2 amino acid sequence
WASTRES

SEQ ID NO: 3390 - DNA, 21 bp, Artificial Sequence
  Description of Artificial Sequence: Synthetic Light chain variable region CDR L2 nucleic acid sequence
tgggcatctacccgggaatcc

SEQ ID NO: 3391 - protein, 8 aa, Artificial Sequence
  Description of Artificial Sequence: Synthetic Light chain variable region CDR L3 amino acid sequence
KQSYSLRT

SEQ ID NO: 3392 - DNA, 24 bp, Artificial Sequence
  Description of Artificial Sequence: Synthetic Light chain variable region CDR L3 nucleic acid sequence
aagcaatcttattctctgagaact

SEQ ID NO: 3393 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggattcaacatcaaggactactatatgcactgggtgcgacaggcccctggacaagggcttgagtggataggatggatcgaccctgaaaatggtaacacaatctacgacccgaagttccagggcagagccaccataaccgcggacacgtccacgaacacagcctacatggagctgagcagcctgagatctgaggacacggcggtgtactactgcgccagagatggttatgccagatactactttgactactggggccaaggaaccctggtcaccgtctcctca

SEQ ID NO: 3394 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQGLEWIGWIDPENGNTIYDPKFQGRATITADTSTNTAYMELSSLRSEDTAVYYCARDGYARYYFDYWGQGTLVTVSS

SEQ ID NO: 3395 - protein, 9 aa, Artificial Sequence
  Description of Artificial Sequence: Synthetic Heavy chain variable region CDR H1 amino acid sequence
FNIKDYYMH

SEQ ID NO: 3396 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3397 - protein, 17 aa, Artificial Sequence
  Description of Artificial Sequence: Synthetic Heavy chain variable region CDR H2 amino acid sequence
WIDPENGNTIYDPKFQG

SEQ ID NO: 3398 - DNA, 51 bp, Artificial Sequence; identical to SEQ ID NO: 3366
  Description of Artificial Sequence: Synthetic Heavy chain variable region CDR H2 nucleic acid sequence

SEQ ID NO: 3399 - protein, 12 aa, Artificial Sequence
  Description of Artificial Sequence: Synthetic Heavy chain variable region CDR H3 amino acid sequence
ARDGYARYYFDY

SEQ ID NO: 3400 - DNA, 36 bp, Artificial Sequence
  Description of Artificial Sequence: Synthetic Heavy chain variable region CDR H3 nucleic acid sequence
gccagagatggttatgccagatactactttgactac

SEQ ID NO: 3401 - DNA, 336 bp, Artificial Sequence; identical to SEQ ID NO: 2985
  Description of Artificial Sequence: Synthetic Light chain variable region nucleic acid sequence

SEQ ID NO: 3402 - protein, 112 aa, Artificial Sequence; identical to SEQ ID NO: 2986
  Description of Artificial Sequence: Synthetic Light chain variable region amino acid sequence

SEQ ID NO: 3403 - protein, 17 aa, Artificial Sequence
  Description of Artificial Sequence: Synthetic Light chain variable region CDR L1 amino acid sequence
KSSQSLLNSRTRKNYLA

SEQ ID NO: 3404 - DNA, 51 bp, Artificial Sequence; identical to SEQ ID NO: 2988
  Description of Artificial Sequence: Synthetic Light chain variable region CDR L1 nucleic acid sequence

SEQ ID NO: 3405 - protein, 7 aa, Artificial Sequence
  Description of Artificial Sequence: Synthetic Light chain variable region CDR L2 amino acid sequence
WASTRES

SEQ ID NO: 3406 - DNA, 21 bp, Artificial Sequence
  Description of Artificial Sequence: Synthetic Light chain variable region CDR L2 nucleic acid sequence
tgggcatctacccgggaatcc

SEQ ID NO: 3407 - protein, 8 aa, Artificial Sequence
  Description of Artificial Sequence: Synthetic Light chain variable region CDR L3 amino acid sequence
KQSYSLRT

SEQ ID NO: 3408 - DNA, 24 bp, Artificial Sequence
  Description of Artificial Sequence: Synthetic Light chain variable region CDR L3 nucleic acid sequence
aagcaatcttattctctgagaact

SEQ ID NO: 3409 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggcccctggacaaaggcttgagtggatgggatggatcgaccctgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatattactttgactactggggccaaggaaccctggtcaccgtctcctca

SEQ ID NO: 3410 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDPENGNTIYDPKFQGRVTITRDTSASTAYMELSSLRSEDTAVYYCARDGYARYYFDYWGQGTLVTVSS

SEQ ID NO: 3411 - protein, 9 aa, Artificial Sequence
  Description of Artificial Sequence: Synthetic Heavy chain variable region CDR H1 amino acid sequence
FNIKDYYMH

SEQ ID NO: 3412 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3413 - protein, 17 aa, Artificial Sequence
  Description of Artificial Sequence: Synthetic Heavy chain variable region CDR H2 amino acid sequence
WIDPENGNTIYDPKFQG

SEQ ID NO: 3414 - DNA, 51 bp, Artificial Sequence
  Description of Artificial Sequence: Synthetic Heavy chain variable region CDR H2 nucleic acid sequence
tggatcgaccctgaaaatggtaacacaatctatgacccgaagtttcagggc

SEQ ID NO: 3415 - protein, 12 aa, Artificial Sequence
  Description of Artificial Sequence: Synthetic Heavy chain variable region CDR H3 amino acid sequence
ARDGYARYYFDY

SEQ ID NO: 3416 - DNA, 36 bp, Artificial Sequence
  Description of Artificial Sequence: Synthetic Heavy chain variable region CDR H3 nucleic acid sequence
gcgagagatggatacgctagatattactttgactac

SEQ ID NO: 3417 - DNA, 336 bp, Artificial Sequence; identical to SEQ ID NO: 2985
  Description of Artificial Sequence: Synthetic Light chain variable region nucleic acid sequence

SEQ ID NO: 3418 - protein, 112 aa, Artificial Sequence; identical to SEQ ID NO: 2986
  Description of Artificial Sequence: Synthetic Light chain variable region amino acid sequence

SEQ ID NO: 3419 - protein, 17 aa, Artificial Sequence
  Description of Artificial Sequence: Synthetic Light chain variable region CDR L1 amino acid sequence
KSSQSLLNSRTRKNYLA

SEQ ID NO: 3420 - DNA, 51 bp, Artificial Sequence; identical to SEQ ID NO: 2988
  Description of Artificial Sequence: Synthetic Light chain variable region CDR L1 nucleic acid sequence

SEQ ID NO: 3421 - protein, 7 aa, Artificial Sequence
  Description of Artificial Sequence: Synthetic Light chain variable region CDR L2 amino acid sequence
WASTRES

SEQ ID NO: 3422 - DNA, 21 bp, Artificial Sequence
  Description of Artificial Sequence: Synthetic Light chain variable region CDR L2 nucleic acid sequence
tgggcatctacccgggaatcc

SEQ ID NO: 3423 - protein, 8 aa, Artificial Sequence
  Description of Artificial Sequence: Synthetic Light chain variable region CDR L3 amino acid sequence
KQSYSLRT

SEQ ID NO: 3424 - DNA, 24 bp, Artificial Sequence
  Description of Artificial Sequence: Synthetic Light chain variable region CDR L3 nucleic acid sequence
aagcaatcttattctctgagaact

SEQ ID NO: 3425 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggcccctggacaaaggcttgagtggataggatggatcgaccctgaaaatggtaacacaatctatgacccgaagtttcagggcagggtcaccataaccgcggacacgtccgccagcacagcctacatggagctgagcagcctgagatctgaagacacggcggtgtactactgcgctagagacggttacgccagatattactttgactactggggccaaggaaccctggtcaccgtctcctca

SEQ ID NO: 3426 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWIGWIDPENGNTIYDPKFQGRVTITADTSASTAYMELSSLRSEDTAVYYCARDGYARYYFDYWGQGTLVTVSS

SEQ ID NO: 3427 - protein, 9 aa, Artificial Sequence
  Description of Artificial Sequence: Synthetic Heavy chain variable region CDR H1 amino acid sequence
FNIKDYYMH

SEQ ID NO: 3428 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3429 - protein, 17 aa, Artificial Sequence
  Description of Artificial Sequence: Synthetic Heavy chain variable region CDR H2 amino acid sequence
WIDPENGNTIYDPKFQG

SEQ ID NO: 3430 - DNA, 51 bp, Artificial Sequence; identical to SEQ ID NO: 3414
  Description of Artificial Sequence: Synthetic Heavy chain variable region CDR H2 nucleic acid sequence

SEQ ID NO: 3431 - protein, 12 aa, Artificial Sequence
  Description of Artificial Sequence: Synthetic Heavy chain variable region CDR H3 amino acid sequence
ARDGYARYYFDY

SEQ ID NO: 3432 - DNA, 36 bp, Artificial Sequence
  Description of Artificial Sequence: Synthetic Heavy chain variable region CDR H3 nucleic acid sequence
gctagagacggttacgccagatattactttgactac

SEQ ID NO: 3433 - DNA, 336 bp, Artificial Sequence; identical to SEQ ID NO: 2985
  Description of Artificial Sequence: Synthetic Light chain variable region nucleic acid sequence

SEQ ID NO: 3434 - protein, 112 aa, Artificial Sequence; identical to SEQ ID NO: 2986
  Description of Artificial Sequence: Synthetic Light chain variable region amino acid sequence

SEQ ID NO: 3435 - protein, 17 aa, Artificial Sequence
  Description of Artificial Sequence: Synthetic Light chain variable region CDR L1 amino acid sequence
KSSQSLLNSRTRKNYLA

SEQ ID NO: 3436 - DNA, 51 bp, Artificial Sequence; identical to SEQ ID NO: 2988
  Description of Artificial Sequence: Synthetic Light chain variable region CDR L1 nucleic acid sequence

SEQ ID NO: 3437 - protein, 7 aa, Artificial Sequence
  Description of Artificial Sequence: Synthetic Light chain variable region CDR L2 amino acid sequence
WASTRES

SEQ ID NO: 3438 - DNA, 21 bp, Artificial Sequence
  Description of Artificial Sequence: Synthetic Light chain variable region CDR L2 nucleic acid sequence
tgggcatctacccgggaatcc

SEQ ID NO: 3439 - protein, 8 aa, Artificial Sequence
  Description of Artificial Sequence: Synthetic Light chain variable region CDR L3 amino acid sequence
KQSYSLRT

SEQ ID NO: 3440 - DNA, 24 bp, Artificial Sequence
  Description of Artificial Sequence: Synthetic Light chain variable region CDR L3 nucleic acid sequence
aagcaatcttattctctgagaact

SEQ ID NO: 3441 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggcccctggacaaaggcttgagtggataggatggatcgaccctgaaaatggtaacacaatctatgacccgaagtttcagggcagggccaccataaccgcggacacgtccgccaacacagcctacatggagctgagcagcctgagatctgaagacacggcggtgtactactgcgcgagagacggatacgcgagatactactttgactactggggccaaggaaccctggtcaccgtctcctca

SEQ ID NO: 3442 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWIGWIDPENGNTIYDPKFQGRATITADTSANTAYMELSSLRSEDTAVYYCARDGYARYYFDYWGQGTLVTVSS

SEQ ID NO: 3443 - protein, 9 aa, Artificial Sequence
  Description of Artificial Sequence: Synthetic Heavy chain variable region CDR H1 amino acid sequence
FNIKDYYMH

SEQ ID NO: 3444 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3445 - protein, 17 aa, Artificial Sequence
  Description of Artificial Sequence: Synthetic Heavy chain variable region CDR H2 amino acid sequence
WIDPENGNTIYDPKFQG

SEQ ID NO: 3446 - DNA, 51 bp, Artificial Sequence; identical to SEQ ID NO: 3414
  Description of Artificial Sequence: Synthetic Heavy chain variable region CDR H2 nucleic acid sequence

SEQ ID NO: 3447 - protein, 12 aa, Artificial Sequence
  Description of Artificial Sequence: Synthetic Heavy chain variable region CDR H3 amino acid sequence
ARDGYARYYFDY

SEQ ID NO: 3448 - DNA, 36 bp, Artificial Sequence
  Description of Artificial Sequence: Synthetic Heavy chain variable region CDR H3 nucleic acid sequence
gcgagagacggatacgcgagatactactttgactac

SEQ ID NO: 3449 - DNA, 336 bp, Artificial Sequence; identical to SEQ ID NO: 2985
  Description of Artificial Sequence: Synthetic Light chain variable region nucleic acid sequence

SEQ ID NO: 3450 - protein, 112 aa, Artificial Sequence; identical to SEQ ID NO: 2986
  Description of Artificial Sequence: Synthetic Light chain variable region amino acid sequence

SEQ ID NO: 3451 - protein, 17 aa, Artificial Sequence
  Description of Artificial Sequence: Synthetic Light chain variable region CDR L1 amino acid sequence
KSSQSLLNSRTRKNYLA

SEQ ID NO: 3452 - DNA, 51 bp, Artificial Sequence; identical to SEQ ID NO: 2988
  Description of Artificial Sequence: Synthetic Light chain variable region CDR L1 nucleic acid sequence

SEQ ID NO: 3453 - protein, 7 aa, Artificial Sequence
  Description of Artificial Sequence: Synthetic Light chain variable region CDR L2 amino acid sequence
WASTRES

SEQ ID NO: 3454 - DNA, 21 bp, Artificial Sequence
  Description of Artificial Sequence: Synthetic Light chain variable region CDR L2 nucleic acid sequence
tgggcatctacccgggaatcc

SEQ ID NO: 3455 - protein, 8 aa, Artificial Sequence
  Description of Artificial Sequence: Synthetic Light chain variable region CDR L3 amino acid sequence
KQSYSLRT

SEQ ID NO: 3456 - DNA, 24 bp, Artificial Sequence
  Description of Artificial Sequence: Synthetic Light chain variable region CDR L3 nucleic acid sequence
aagcaatcttattctctgagaact

SEQ ID NO: 3457 - DNA, 357 bp, Artificial Sequence; identical to SEQ ID NO: 3361
  Description of Artificial Sequence: Synthetic Heavy chain variable region nucleic acid sequence

SEQ ID NO: 3458 - protein, 119 aa, Artificial Sequence; identical to SEQ ID NO: 3362
  Description of Artificial Sequence: Synthetic Heavy chain variable region amino acid sequence

SEQ ID NO: 3459 - protein, 9 aa, Artificial Sequence
  Description of Artificial Sequence: Synthetic Heavy chain variable region CDR H1 amino acid sequence
FNIKDYYMH

SEQ ID NO: 3460 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3461 - protein, 17 aa, Artificial Sequence
  Description of Artificial Sequence: Synthetic Heavy chain variable region CDR H2 amino acid sequence
WIDPENGNTIYDPKFQG

SEQ ID NO: 3462 - DNA, 51 bp, Artificial Sequence; identical to SEQ ID NO: 3366
  Description of Artificial Sequence: Synthetic Heavy chain variable region CDR H2 nucleic acid sequence

SEQ ID NO: 3463 - protein, 12 aa, Artificial Sequence
  Description of Artificial Sequence: Synthetic Heavy chain variable region CDR H3 amino acid sequence
ARDGYARYYFDY

SEQ ID NO: 3464 - DNA, 36 bp, Artificial Sequence; identical to SEQ ID NO: 3368
  Description of Artificial Sequence: Synthetic Heavy chain variable region CDR H3 nucleic acid sequence

SEQ ID NO: 3465 - DNA, 336 bp, Artificial Sequence; identical to SEQ ID NO: 3081
  Description of Artificial Sequence: Synthetic Light chain variable region nucleic acid sequence

SEQ ID NO: 3466 - protein, 112 aa, Artificial Sequence; identical to SEQ ID NO: 3082
  Description of Artificial Sequence: Synthetic Light chain variable region amino acid sequence

SEQ ID NO: 3467 - protein, 17 aa, Artificial Sequence
  Description of Artificial Sequence: Synthetic Light chain variable region CDR L1 amino acid sequence
KSSQSLLNSRTRKNYLA

SEQ ID NO: 3468 - DNA, 51 bp, Artificial Sequence; identical to SEQ ID NO: 2988
  Description of Artificial Sequence: Synthetic Light chain variable region CDR L1 nucleic acid sequence

SEQ ID NO: 3469 - protein, 7 aa, Artificial Sequence
  Description of Artificial Sequence: Synthetic Light chain variable region CDR L2 amino acid sequence
WASTRES

SEQ ID NO: 3470 - DNA, 21 bp, Artificial Sequence
  Description of Artificial Sequence: Synthetic Light chain variable region CDR L2 nucleic acid sequence
tgggcatctacccgggaatcc

SEQ ID NO: 3471 - protein, 8 aa, Artificial Sequence
  Description of Artificial Sequence: Synthetic Light chain variable region CDR L3 amino acid sequence
KQSYNLRT

SEQ ID NO: 3472 - DNA, 24 bp, Artificial Sequence
  Description of Artificial Sequence: Synthetic Light chain variable region CDR L3 nucleic acid sequence
aagcagagttacaatttgagaact

SEQ ID NO: 3473 - DNA, 357 bp, Artificial Sequence; identical to SEQ ID NO: 3393
  Description of Artificial Sequence: Synthetic Heavy chain variable region nucleic acid sequence

SEQ ID NO: 3474 - protein, 119 aa, Artificial Sequence; identical to SEQ ID NO: 3394
  Description of Artificial Sequence: Synthetic Heavy chain variable region amino acid sequence

SEQ ID NO: 3475 - protein, 9 aa, Artificial Sequence
  Description of Artificial Sequence: Synthetic Heavy chain variable region CDR H1 amino acid sequence
FNIKDYYMH

SEQ ID NO: 3476 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3477 - protein, 17 aa, Artificial Sequence
  Description of Artificial Sequence: Synthetic Heavy chain variable region CDR H2 amino acid sequence
WIDPENGNTIYDPKFQG

SEQ ID NO: 3478 - DNA, 51 bp, Artificial Sequence; identical to SEQ ID NO: 3366
  Description of Artificial Sequence: Synthetic Heavy chain variable region CDR H2 nucleic acid sequence

SEQ ID NO: 3479 - protein, 12 aa, Artificial Sequence
  Description of Artificial Sequence: Synthetic Heavy chain variable region CDR H3 amino acid sequence
ARDGYARYYFDY

SEQ ID NO: 3480 - DNA, 36 bp, Artificial Sequence; identical to SEQ ID NO: 3400
  Description of Artificial Sequence: Synthetic Heavy chain variable region CDR H3 nucleic acid sequence

SEQ ID NO: 3481 - DNA, 336 bp, Artificial Sequence; identical to SEQ ID NO: 3081
  Description of Artificial Sequence: Synthetic Light chain variable region nucleic acid sequence

SEQ ID NO: 3482 - protein, 112 aa, Artificial Sequence; identical to SEQ ID NO: 3082
  Description of Artificial Sequence: Synthetic Light chain variable region amino acid sequence

SEQ ID NO: 3483 - protein, 17 aa, Artificial Sequence
  Description of Artificial Sequence: Synthetic Light chain variable region CDR L1 amino acid sequence
KSSQSLLNSRTRKNYLA

SEQ ID NO: 3484 - DNA, 51 bp, Artificial Sequence; identical to SEQ ID NO: 2988
  Description of Artificial Sequence: Synthetic Light chain variable region CDR L1 nucleic acid sequence

SEQ ID NO: 3485 - protein, 7 aa, Artificial Sequence
  Description of Artificial Sequence: Synthetic Light chain variable region CDR L2 amino acid sequence
WASTRES

SEQ ID NO: 3486 - DNA, 21 bp, Artificial Sequence
  Description of Artificial Sequence: Synthetic Light chain variable region CDR L2 nucleic acid sequence
tgggcatctacccgggaatcc

SEQ ID NO: 3487 - protein, 8 aa, Artificial Sequence
  Description of Artificial Sequence: Synthetic Light chain variable region CDR L3 amino acid sequence
KQSYNLRT

SEQ ID NO: 3488 - DNA, 24 bp, Artificial Sequence
  Description of Artificial Sequence: Synthetic Light chain variable region CDR L3 nucleic acid sequence
aagcagagttacaatttgagaact

SEQ ID NO: 3489 - DNA, 357 bp, Artificial Sequence; identical to SEQ ID NO: 3409
  Description of Artificial Sequence: Synthetic Heavy chain variable region nucleic acid sequence

SEQ ID NO: 3490 - protein, 119 aa, Artificial Sequence; identical to SEQ ID NO: 3410
  Description of Artificial Sequence: Synthetic Heavy chain variable region amino acid sequence

SEQ ID NO: 3491 - protein, 9 aa, Artificial Sequence
  Description of Artificial Sequence: Synthetic Heavy chain variable region CDR H1 amino acid sequence
FNIKDYYMH

SEQ ID NO: 3492 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3493 - protein, 17 aa, Artificial Sequence
  Description of Artificial Sequence: Synthetic Heavy chain variable region CDR H2 amino acid sequence
WIDPENGNTIYDPKFQG

SEQ ID NO: 3494 - DNA, 51 bp, Artificial Sequence; identical to SEQ ID NO: 3414
  Description of Artificial Sequence: Synthetic Heavy chain variable region CDR H2 nucleic acid sequence

SEQ ID NO: 3495 - protein, 12 aa, Artificial Sequence
  Description of Artificial Sequence: Synthetic Heavy chain variable region CDR H3 amino acid sequence
ARDGYARYYFDY

SEQ ID NO: 3496 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3497 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagtgggtctgggacagatttcactctcaccatcagcagcctgcaggctgaagatgtggcagtttattactgtaagcagagttacaatttgagaactttcggcggagggaccaaggtggagatcaaa

SEQ ID NO: 3498 - protein, 112 aa, Artificial Sequence; identical to SEQ ID NO: 3082
  Description of Artificial Sequence: Synthetic Light chain variable region amino acid sequence

SEQ ID NO: 3499 - protein, 17 aa, Artificial Sequence
  Description of Artificial Sequence: Synthetic Light chain variable region CDR L1 amino acid sequence
KSSQSLLNSRTRKNYLA

SEQ ID NO: 3500 - DNA, 51 bp, Artificial Sequence; identical to SEQ ID NO: 2988
  Description of Artificial Sequence: Synthetic Light chain variable region CDR L1 nucleic acid sequence

SEQ ID NO: 3501 - protein, 7 aa, Artificial Sequence
  Description of Artificial Sequence: Synthetic Light chain variable region CDR L2 amino acid sequence
WASTRES

SEQ ID NO: 3502 - DNA, 21 bp, Artificial Sequence
  Description of Artificial Sequence: Synthetic Light chain variable region CDR L2 nucleic acid sequence
tgggcatctacccgggaatcc

SEQ ID NO: 3503 - protein, 8 aa, Artificial Sequence
  Description of Artificial Sequence: Synthetic Light chain variable region CDR L3 amino acid sequence
KQSYNLRT

SEQ ID NO: 3504 - DNA, 24 bp, Artificial Sequence
  Description of Artificial Sequence: Synthetic Light chain variable region CDR L3 nucleic acid sequence
aagcagagttacaatttgagaact

SEQ ID NO: 3505 - DNA, 357 bp, Artificial Sequence; identical to SEQ ID NO: 3425
  Description of Artificial Sequence: Synthetic Heavy chain variable region nucleic acid sequence

SEQ ID NO: 3506 - protein, 119 aa, Artificial Sequence; identical to SEQ ID NO: 3426
  Description of Artificial Sequence: Synthetic Heavy chain variable region amino acid sequence

SEQ ID NO: 3507 - protein, 9 aa, Artificial Sequence
  Description of Artificial Sequence: Synthetic Heavy chain variable region CDR H1 amino acid sequence
FNIKDYYMH

SEQ ID NO: 3508 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3509 - protein, 17 aa, Artificial Sequence
  Description of Artificial Sequence: Synthetic Heavy chain variable region CDR H2 amino acid sequence
WIDPENGNTIYDPKFQG

SEQ ID NO: 3510 - DNA, 51 bp, Artificial Sequence; identical to SEQ ID NO: 3414
  Description of Artificial Sequence: Synthetic Heavy chain variable region CDR H2 nucleic acid sequence

SEQ ID NO: 3511 - protein, 12 aa, Artificial Sequence
  Description of Artificial Sequence: Synthetic Heavy chain variable region CDR H3 amino acid sequence
ARDGYARYYFDY

SEQ ID NO: 3512 - DNA, 36 bp, Artificial Sequence; identical to SEQ ID NO: 3432
  Description of Artificial Sequence: Synthetic Heavy chain variable region CDR H3 nucleic acid sequence

SEQ ID NO: 3513 - DNA, 336 bp, Artificial Sequence; identical to SEQ ID NO: 3081
  Description of Artificial Sequence: Synthetic Light chain variable region nucleic acid sequence

SEQ ID NO: 3514 - protein, 112 aa, Artificial Sequence; identical to SEQ ID NO: 3082
  Description of Artificial Sequence: Synthetic Light chain variable region amino acid sequence

SEQ ID NO: 3515 - protein, 17 aa, Artificial Sequence
  Description of Artificial Sequence: Synthetic Light chain variable region CDR L1 amino acid sequence
KSSQSLLNSRTRKNYLA

SEQ ID NO: 3516 - DNA, 51 bp, Artificial Sequence; identical to SEQ ID NO: 2988
  Description of Artificial Sequence: Synthetic Light chain variable region CDR L1 nucleic acid sequence

SEQ ID NO: 3517 - protein, 7 aa, Artificial Sequence
  Description of Artificial Sequence: Synthetic Light chain variable region CDR L2 amino acid sequence
WASTRES

SEQ ID NO: 3518 - DNA, 21 bp, Artificial Sequence
  Description of Artificial Sequence: Synthetic Light chain variable region CDR L2 nucleic acid sequence
tgggcatctacccgggaatcc

SEQ ID NO: 3519 - protein, 8 aa, Artificial Sequence
  Description of Artificial Sequence: Synthetic Light chain variable region CDR L3 amino acid sequence
KQSYNLRT

SEQ ID NO: 3520 - DNA, 24 bp, Artificial Sequence
  Description of Artificial Sequence: Synthetic Light chain variable region CDR L3 nucleic acid sequence
aagcagagttacaatttgagaact

SEQ ID NO: 3521 - DNA, 357 bp, Artificial Sequence; identical to SEQ ID NO: 3441
  Description of Artificial Sequence: Synthetic Heavy chain variable region nucleic acid sequence

SEQ ID NO: 3522 - protein, 119 aa, Artificial Sequence; identical to SEQ ID NO: 3442
  Description of Artificial Sequence: Synthetic Heavy chain variable region amino acid sequence

SEQ ID NO: 3523 - protein, 9 aa, Artificial Sequence
  Description of Artificial Sequence: Synthetic Heavy chain variable region CDR H1 amino acid sequence
FNIKDYYMH

SEQ ID NO: 3524 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3525 - protein, 17 aa, Artificial Sequence
  Description of Artificial Sequence: Synthetic Heavy chain variable region CDR H2 amino acid sequence
WIDPENGNTIYDPKFQG

SEQ ID NO: 3526 - DNA, 51 bp, Artificial Sequence; identical to SEQ ID NO: 3414
  Description of Artificial Sequence: Synthetic Heavy chain variable region CDR H2 nucleic acid sequence

SEQ ID NO: 3527 - protein, 12 aa, Artificial Sequence
  Description of Artificial Sequence: Synthetic Heavy chain variable region CDR H3 amino acid sequence
ARDGYARYYFDY

SEQ ID NO: 3528 - DNA, 36 bp, Artificial Sequence; identical to SEQ ID NO: 3448
  Description of Artificial Sequence: Synthetic Heavy chain variable region CDR H3 nucleic acid sequence

SEQ ID NO: 3529 - DNA, 336 bp, Artificial Sequence; identical to SEQ ID NO: 3081
  Description of Artificial Sequence: Synthetic Light chain variable region nucleic acid sequence

SEQ ID NO: 3530 - protein, 112 aa, Artificial Sequence; identical to SEQ ID NO: 3082
  Description of Artificial Sequence: Synthetic Light chain variable region amino acid sequence

SEQ ID NO: 3531 - protein, 17 aa, Artificial Sequence
  Description of Artificial Sequence: Synthetic Light chain variable region CDR L1 amino acid sequence
KSSQSLLNSRTRKNYLA

SEQ ID NO: 3532 - DNA, 51 bp, Artificial Sequence; identical to SEQ ID NO: 2988
  Description of Artificial Sequence: Synthetic Light chain variable region CDR L1 nucleic acid sequence

SEQ ID NO: 3533 - protein, 7 aa, Artificial Sequence
  Description of Artificial Sequence: Synthetic Light chain variable region CDR L2 amino acid sequence
WASTRES

SEQ ID NO: 3534 - DNA, 21 bp, Artificial Sequence
  Description of Artificial Sequence: Synthetic Light chain variable region CDR L2 nucleic acid sequence
tgggcatctacccgggaatcc

SEQ ID NO: 3535 - protein, 8 aa, Artificial Sequence
  Description of Artificial Sequence: Synthetic Light chain variable region CDR L3 amino acid sequence
KQSYNLRT

SEQ ID NO: 3536 - DNA, 24 bp, Artificial Sequence
  Description of Artificial Sequence: Synthetic Light chain variable region CDR L3 nucleic acid sequence
aagcagagttacaatttgagaact

SEQ ID NO: 3537 - DNA, 357 bp, Artificial Sequence; identical to SEQ ID NO: 3377
  Description of Artificial Sequence: Synthetic Heavy chain variable region nucleic acid sequence

SEQ ID NO: 3538 - protein, 119 aa, Artificial Sequence; identical to SEQ ID NO: 3378
  Description of Artificial Sequence: Synthetic Heavy chain variable region amino acid sequence

SEQ ID NO: 3539 - protein, 9 aa, Artificial Sequence
  Description of Artificial Sequence: Synthetic Heavy chain variable region CDR H1 amino acid sequence
FNIKDYYMH

SEQ ID NO: 3540 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3541 - protein, 17 aa, Artificial Sequence
  Description of Artificial Sequence: Synthetic Heavy chain variable region CDR H2 amino acid sequence
WIDPENGNTIYDPKFQG

SEQ ID NO: 3542 - DNA, 51 bp, Artificial Sequence; identical to SEQ ID NO: 3366
  Description of Artificial Sequence: Synthetic Heavy chain variable region CDR H2 nucleic acid sequence

SEQ ID NO: 3543 - protein, 12 aa, Artificial Sequence
  Description of Artificial Sequence: Synthetic Heavy chain variable region CDR H3 amino acid sequence
ARDGYARYYFDY

SEQ ID NO: 3544 - DNA, 36 bp, Artificial Sequence; identical to SEQ ID NO: 3384
  Description of Artificial Sequence: Synthetic Heavy chain variable region CDR H3 nucleic acid sequence

SEQ ID NO: 3545 - DNA, 336 bp, Artificial Sequence; identical to SEQ ID NO: 3081
  Description of Artificial Sequence: Synthetic Light chain variable region nucleic acid sequence

SEQ ID NO: 3546 - protein, 112 aa, Artificial Sequence; identical to SEQ ID NO: 3082
  Description of Artificial Sequence: Synthetic Light chain variable region amino acid sequence

SEQ ID NO: 3547 - protein, 17 aa, Artificial Sequence
  Description of Artificial Sequence: Synthetic Light chain variable region CDR L1 amino acid sequence
KSSQSLLNSRTRKNYLA

SEQ ID NO: 3548 - DNA, 51 bp, Artificial Sequence; identical to SEQ ID NO: 2988
  Description of Artificial Sequence: Synthetic Light chain variable region CDR L1 nucleic acid sequence

SEQ ID NO: 3549 - protein, 7 aa, Artificial Sequence
  Description of Artificial Sequence: Synthetic Light chain variable region CDR L2 amino acid sequence
WASTRES

SEQ ID NO: 3550 - DNA, 21 bp, Artificial Sequence
  Description of Artificial Sequence: Synthetic Light chain variable region CDR L2 nucleic acid sequence
tgggcatctacccgggaatcc

SEQ ID NO: 3551 - protein, 8 aa, Artificial Sequence
  Description of Artificial Sequence: Synthetic Light chain variable region CDR L3 amino acid sequence
KQSYNLRT

SEQ ID NO: 3552 - DNA, 24 bp, Artificial Sequence
  Description of Artificial Sequence: Synthetic Light chain variable region CDR L3 nucleic acid sequence
aagcagagttacaatttgagaact

SEQ ID NO: 3553 - DNA, 360 bp, Artificial Sequence
  Description of Artificial Sequence: Synthetic Heavy chain variable region nucleic acid sequence
caggtccagcttgtacagtctggggctgaggtgaagaagcctggggcctcagtgaagatttcctgcaaggcttcgggataccccttcagttcctatcctatgcattgggtgcgccaggcccccggacaaaggcttgagtggatgggatggatcaacgttgacaatgagaacacaaaatattcatggaagttccggggcagagtcaccattaccagggacacatccgcgagcacagtttacatggagctgagcagtctgatatctgaagacacggctgtgtattactgtgggagagactgggacggggcgatccgtgtcttggactactggggccagggaaccctggtcaccgtctcctca

SEQ ID NO: 3554 - protein, 120 aa, Artificial Sequence
  Description of Artificial Sequence: Synthetic Heavy chain variable region amino acid sequence
QVQLVQSGAEVKKPGASVKISCKASGYPFSSYPMHWVRQAPGQRLEWMGWINVDNENTKYSWKFRGRVTITRDTSASTVYMELSSLISEDTAVYYCGRDWDGAIRVLDYWGQGTLVTVSS

SEQ ID NO: 3555 - protein, 9 aa, Artificial Sequence
  Description of Artificial Sequence: Synthetic Heavy chain variable region CDR H1 amino acid sequence
YPFSSYPMH

SEQ ID NO: 3556 - DNA, 27 bp, Artificial Sequence
  Description of Artificial Sequence: Synthetic Heavy chain variable region CDR H1 nucleic acid sequence
taccccttcagttcctatcctatgcat

SEQ ID NO: 3557 - protein, 17 aa, Artificial Sequence
  Description of Artificial Sequence: Synthetic Heavy chain variable region CDR H2 amino acid sequence
WINVDNENTKYSWKFRG

SEQ ID NO: 3558 - DNA, 51 bp, Artificial Sequence
  Description of Artificial Sequence: Synthetic Heavy chain variable region CDR H2 nucleic acid sequence
tggatcaacgttgacaatgagaacacaaaatattcatggaagttccggggc

SEQ ID NO: 3559 - protein, 13 aa, Artificial Sequence
  Description of Artificial Sequence: Synthetic Heavy chain variable region CDR H3 amino acid sequence
GRDWDGAIRVLDY

SEQ ID NO: 3560 - DNA, 39 bp, Artificial Sequence
  Description of Artificial Sequence: Synthetic Heavy chain variable region CDR H3 nucleic acid sequence
gggagagactgggacggggcgatccgtgtcttggactac

SEQ ID NO: 3561 - DNA, 339 bp, Artificial Sequence
  Description of Artificial Sequence: Synthetic Light chain variable region nucleic acid sequence
gatattgtgatgactcagactccagactccctggctgtgtctctgggcgagagggccaccatcacctgcaagtccagccagagtgttttattcagctccgacaataagaactacttagcttggtaccagcagaaaccgggacagcctcctaaattgctcatttactgggcatctatccgggaatccggggtccctgaccgattcggtggcagcgggtctgggacacatttcactctcaccatcaccagcgtgcaggctgcagatgtggcagtttattactgtcagcaatattatggtaatttccccaccttcggccaagggacacgactggagattaaa

SEQ ID NO: 3562 - protein, 113 aa, Artificial Sequence
  Description of Artificial Sequence: Synthetic Light chain variable region amino acid sequence
DIVMTQTPDSLAVSLGERATITCKSSQSVLFSSDNKNYLAWYQQKPGQPPKLLIYWASIRESGVPDRFGGSGSGTHFTLTITSVQAADVAVYYCQQYYGNFPTFGQGTRLEIK

SEQ ID NO: 3563 - protein, 17 aa, Artificial Sequence
  Description of Artificial Sequence: Synthetic Light chain variable region CDR L1 amino acid sequence
KSSQSVLFSSDNKNYLA

SEQ ID NO: 3564 - DNA, 51 bp, Artificial Sequence
  Description of Artificial Sequence: Synthetic Light chain variable region CDR L1 nucleic acid sequence
aagtccagccagagtgttttattcagctccgacaataagaactacttagct

SEQ ID NO: 3565 - protein, 7 aa, Artificial Sequence
  Description of Artificial Sequence: Synthetic Light chain variable region CDR L2 amino acid sequence
WASIRES

SEQ ID NO: 3566 - DNA, 21 bp, Artificial Sequence
  Description of Artificial Sequence: Synthetic Light chain variable region CDR L2 nucleic acid sequence
tgggcatctatccgggaatcc

SEQ ID NO: 3567 - protein, 9 aa, Artificial Sequence
  Description of Artificial Sequence: Synthetic Light chain variable region CDR L3 amino acid sequence
QQYYGNFPT

SEQ ID NO: 3568 - DNA, 27 bp, Artificial Sequence
  Description of Artificial Sequence: Synthetic Light chain variable region CDR L3 nucleic acid sequence
cagcaatattatggtaatttccccacc

SEQ ID NO: 3569 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatattactttgactactggggccaaggaaccctggtcaccgtctcctca

SEQ ID NO: 3570 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYARYYFDYWGQGTLVTVSS

SEQ ID NO: 3571 - protein, 9 aa, Artificial Sequence
  Description of Artificial Sequence: Synthetic Heavy chain variable region CDR H1 amino acid sequence
FNIKDYYMH

SEQ ID NO: 3572 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3573 - protein, 17 aa, Artificial Sequence
  Description of Artificial Sequence: Synthetic Heavy chain variable region CDR H2 amino acid sequence
WIDLENGNTIYDPKFQG

SEQ ID NO: 3574 - DNA, 51 bp, Artificial Sequence
  Description of Artificial Sequence: Synthetic Heavy chain variable region CDR H2 nucleic acid sequence
tggatcgaccttgaaaatggtaacacaatctatgacccgaagtttcagggc

SEQ ID NO: 3575 - protein, 12 aa, Artificial Sequence
  Description of Artificial Sequence: Synthetic Heavy chain variable region CDR H3 amino acid sequence
ARDGYARYYFDY

SEQ ID NO: 3576 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3577 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcaatcttattttcggagagctttcggcggagggaccaaggttgagatcaaa

SEQ ID NO: 3578 - protein, 112 aa, Artificial Sequence
  Description of Artificial Sequence: Synthetic Light chain variable region amino acid sequence
DIVMTQSPDSLAVSLGERATINCKSSQSLLNSRTRKNYLAWYQQKPGQPPKLLIYWASTRESGVPDRFSGSGSGTDFTLTISSLQAEDVAVYYCKQSYFRRAFGGGTKVEIK

SEQ ID NO: 3579 - protein, 17 aa, Artificial Sequence
  Description of Artificial Sequence: Synthetic Light chain variable region CDR L1 amino acid sequence
KSSQSLLNSRTRKNYLA

SEQ ID NO: 3580 - DNA, 51 bp, Artificial Sequence; identical to SEQ ID NO: 2988
  Description of Artificial Sequence: Synthetic Light chain variable region CDR L1 nucleic acid sequence

SEQ ID NO: 3581 - protein, 7 aa, Artificial Sequence
  Description of Artificial Sequence: Synthetic Light chain variable region CDR L2 amino acid sequence
WASTRES

SEQ ID NO: 3582 - DNA, 21 bp, Artificial Sequence
  Description of Artificial Sequence: Synthetic Light chain variable region CDR L2 nucleic acid sequence
tgggcatctacccgggaatcc

SEQ ID NO: 3583 - protein, 8 aa, Artificial Sequence
  Description of Artificial Sequence: Synthetic Light chain variable region CDR L3 amino acid sequence
KQSYFRRA

SEQ ID NO: 3584 - DNA, 24 bp, Artificial Sequence
  Description of Artificial Sequence: Synthetic Light chain variable region CDR L3 nucleic acid sequence
aagcaatcttattttcggagagct

SEQ ID NO: 3585 - DNA, 357 bp, Artificial Sequence
  Description of Artificial Sequence: Synthetic Heavy chain variable region nucleic acid sequence
caggtgcagctggtgcagtctggggctgaggtgaagaagcccggggcctcagtgaaggtctcctgcaaggcttctggattcaacaccaaggactactatatgcactgggtgcgacaggcccccgggcaaaggcttgagtggatgggatggatcggccctgaaaatggtaacacaatctatgacccgaagtttcagggcagggtcaccataaccagggacacgtccgccagcacagcctacatggagctgagcagcctgaggtctgaagacacggcggtgtactactgcgcgagggatggatacgctagatattactttgactactggggccaaggaaccctggtcaccgtctcctca

SEQ ID NO: 3586 - protein, 119 aa, Artificial Sequence
  Description of Artificial Sequence: Synthetic Heavy chain variable region amino acid sequence
QVQLVQSGAEVKKPGASVKVSCKASGFNTKDYYMHWVRQAPGQRLEWMGWIGPENGNTIYDPKFQGRVTITRDTSASTAYMELSSLRSEDTAVYYCARDGYARYYFDYWGQGTLVTVSS

SEQ ID NO: 3587 - protein, 9 aa, Artificial Sequence
  Description of Artificial Sequence: Synthetic Heavy chain variable region CDR H1 amino acid sequence
FNTKDYYMH

SEQ ID NO: 3588 - DNA, 27 bp, Artificial Sequence
  Description of Artificial Sequence: Synthetic Heavy chain variable region CDR H1 nucleic acid sequence
ttcaacaccaaggactactatatgcac

SEQ ID NO: 3589 - protein, 17 aa, Artificial Sequence
  Description of Artificial Sequence: Synthetic Heavy chain variable region CDR H2 amino acid sequence
WIGPENGNTIYDPKFQG

SEQ ID NO: 3590 - DNA, 51 bp, Artificial Sequence
  Description of Artificial Sequence: Synthetic Heavy chain variable region CDR H2 nucleic acid sequence
tggatcggccctgaaaatggtaacacaatctatgacccgaagtttcagggc

SEQ ID NO: 3591 - protein, 12 aa, Artificial Sequence
  Description of Artificial Sequence: Synthetic Heavy chain variable region CDR H3 amino acid sequence
ARDGYARYYFDY

SEQ ID NO: 3592 - DNA, 36 bp, Artificial Sequence
  Description of Artificial Sequence: Synthetic Heavy chain variable region CDR H3 nucleic acid sequence
gcgagggatggatacgctagatattactttgactac

SEQ ID NO: 3593 - DNA, 336 bp, Artificial Sequence
  Description of Artificial Sequence: Synthetic Light chain variable region nucleic acid sequence
gacatcgtaatgacccagtctccagactccctggctgtgtctctgggcgagagggccaccatcaactgcaggtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcaatcttattctcggagaactttcggcggagggaccaaggttgagatcaaa

SEQ ID NO: 3594 - protein, 112 aa, Artificial Sequence
  Description of Artificial Sequence: Synthetic Light chain variable region amino acid sequence
DIVMTQSPDSLAVSLGERATINCRSSQSLLNSRTRKNYLAWYQQKPGQPPKLLIYWASTRESGVPDRFSGSGSGTDFTLTISSLQAEDVAVYYCKQSYSRRTFGGGTKVEIK

SEQ ID NO: 3595 - protein, 17 aa, Artificial Sequence
  Description of Artificial Sequence: Synthetic Light chain variable region CDR L1 amino acid sequence
RSSQSLLNSRTRKNYLA

SEQ ID NO: 3596 - DNA, 51 bp, Artificial Sequence
  Description of Artificial Sequence: Synthetic Light chain variable region CDR L1 nucleic acid sequence
aggtccagccagagtcttttaaacagcagaaccagaaagaactacttagct

SEQ ID NO: 3597 - protein, 7 aa, Artificial Sequence
  Description of Artificial Sequence: Synthetic Light chain variable region CDR L2 amino acid sequence
WASTRES

SEQ ID NO: 3598 - DNA, 21 bp, Artificial Sequence
  Description of Artificial Sequence: Synthetic Light chain variable region CDR L2 nucleic acid sequence
tgggcatctacccgggaatcc

SEQ ID NO: 3599 - protein, 8 aa, Artificial Sequence
  Description of Artificial Sequence: Synthetic Light chain variable region CDR L3 amino acid sequence
KQSYSRRT

SEQ ID NO: 3600 - DNA, 24 bp, Artificial Sequence
  Description of Artificial Sequence: Synthetic Light chain variable region CDR L3 nucleic acid sequence
aagcaatcttattctcggagaact

SEQ ID NO: 3601 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggcccctggacaaaggcttgagtggatgggatggatcgaccttgaaaatggtaacacaatctatgacccgaaatttcagggcagggtcaccataaccagggacacgtccgccagcacagcctacatggagctgagcagcctgagatccgaagacacggcggtgtactactgcgcgagagatggatacgctagatattactttgactactggggccaaggaaccctggtcaccgtctcctca

SEQ ID NO: 3602 - protein, 119 aa, Artificial Sequence; identical to SEQ ID NO: 3570
  Description of Artificial Sequence: Synthetic Heavy chain variable region amino acid sequence

SEQ ID NO: 3603 - protein, 9 aa, Artificial Sequence
  Description of Artificial Sequence: Synthetic Heavy chain variable region CDR H1 amino acid sequence
FNIKDYYMH

SEQ ID NO: 3604 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3605 - protein, 17 aa, Artificial Sequence
  Description of Artificial Sequence: Synthetic Heavy chain variable region CDR H2 amino acid sequence
WIDLENGNTIYDPKFQG

SEQ ID NO: 3606 - DNA, 51 bp, Artificial Sequence
  Description of Artificial Sequence: Synthetic Heavy chain variable region CDR H2 nucleic acid sequence
tggatcgaccttgaaaatggtaacacaatctatgacccgaaatttcagggc

SEQ ID NO: 3607 - protein, 12 aa, Artificial Sequence
  Description of Artificial Sequence: Synthetic Heavy chain variable region CDR H3 amino acid sequence
ARDGYARYYFDY

SEQ ID NO: 3608 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3609 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacggcagaaccagaaagaactacttagcttggtaccagcagaaaccaggacagcctcctaagctgctcatttactgggcatctacccgggaatccggggtccctgaccgattcagtggcagcgggactgggacagatttcactctcaccatcagcagcctgcaggctgaagatgtggcagtttattactgtaagcaatcttattctcggagaactttcggcggagggaccaaggttgagatcaaa

SEQ ID NO: 3610 - protein, 112 aa, Artificial Sequence
  Description of Artificial Sequence: Synthetic Light chain variable region amino acid sequence
DIVMTQSPDSLAVSLGERATINCKSSQSLLNGRTRKNYLAWYQQKPGQPPKLLIYWASTRESGVPDRFSGSGTGTDFTLTISSLQAEDVAVYYCKQSYSRRTFGGGTKVEIK

SEQ ID NO: 3611 - protein, 17 aa, Artificial Sequence
  Description of Artificial Sequence: Synthetic Light chain variable region CDR L1 amino acid sequence
KSSQSLLNGRTRKNYLA

SEQ ID NO: 3612 - DNA, 51 bp, Artificial Sequence
  Description of Artificial Sequence: Synthetic Light chain variable region CDR L1 nucleic acid sequence
aagtccagccagagtcttttaaacggcagaaccagaaagaactacttagct

SEQ ID NO: 3613 - protein, 7 aa, Artificial Sequence
  Description of Artificial Sequence: Synthetic Light chain variable region CDR L2 amino acid sequence
WASTRES

SEQ ID NO: 3614 - DNA, 21 bp, Artificial Sequence
  Description of Artificial Sequence: Synthetic Light chain variable region CDR L2 nucleic acid sequence
tgggcatctacccgggaatcc

SEQ ID NO: 3615 - protein, 8 aa, Artificial Sequence
  Description of Artificial Sequence: Synthetic Light chain variable region CDR L3 amino acid sequence
KQSYSRRT

SEQ ID NO: 3616 - DNA, 24 bp, Artificial Sequence
  Description of Artificial Sequence: Synthetic Light chain variable region CDR L3 nucleic acid sequence
aagcaatcttattctcggagaact

SEQ ID NO: 3617 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaagggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatattactttgactactggggccaaggaaccctggtcaccgtctcctca

SEQ ID NO: 3618 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQGLEWMGWIDLENGNTIYDPKFQGRVTITRDTSASTAYMELSSLRSEDTAVYYCARDGYARYYFDYWGQGTLVTVSS

SEQ ID NO: 3619 - protein, 9 aa, Artificial Sequence
  Description of Artificial Sequence: Synthetic Heavy chain variable region CDR H1 amino acid sequence
FNIKDYYMH

SEQ ID NO: 3620 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3621 - protein, 17 aa, Artificial Sequence
  Description of Artificial Sequence: Synthetic Heavy chain variable region CDR H2 amino acid sequence
WIDLENGNTIYDPKFQG

SEQ ID NO: 3622 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 3623 - protein, 12 aa, Artificial Sequence
  Description of Artificial Sequence: Synthetic Heavy chain variable region CDR H3 amino acid sequence
ARDGYARYYFDY

SEQ ID NO: 3624 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3625 - DNA, 336 bp, Artificial Sequence; identical to SEQ ID NO: 3577
  Description of Artificial Sequence: Synthetic Light chain variable region nucleic acid sequence

SEQ ID NO: 3626 - protein, 112 aa, Artificial Sequence; identical to SEQ ID NO: 3578
  Description of Artificial Sequence: Synthetic Light chain variable region amino acid sequence

SEQ ID NO: 3627 - protein, 17 aa, Artificial Sequence
  Description of Artificial Sequence: Synthetic Light chain variable region CDR L1 amino acid sequence
KSSQSLLNSRTRKNYLA

SEQ ID NO: 3628 - DNA, 51 bp, Artificial Sequence; identical to SEQ ID NO: 2988
  Description of Artificial Sequence: Synthetic Light chain variable region CDR L1 nucleic acid sequence

SEQ ID NO: 3629 - protein, 7 aa, Artificial Sequence
  Description of Artificial Sequence: Synthetic Light chain variable region CDR L2 amino acid sequence
WASTRES

SEQ ID NO: 3630 - DNA, 21 bp, Artificial Sequence
  Description of Artificial Sequence: Synthetic Light chain variable region CDR L2 nucleic acid sequence
tgggcatctacccgggaatcc

SEQ ID NO: 3631 - protein, 8 aa, Artificial Sequence
  Description of Artificial Sequence: Synthetic Light chain variable region CDR L3 amino acid sequence
KQSYFRRA

SEQ ID NO: 3632 - DNA, 24 bp, Artificial Sequence
  Description of Artificial Sequence: Synthetic Light chain variable region CDR L3 nucleic acid sequence
aagcaatcttattttcggagagct

SEQ ID NO: 3633 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggcccctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatattactttgactactggggccaaggaaccctggtcaccgtctcctca

SEQ ID NO: 3634 - protein, 119 aa, Artificial Sequence; identical to SEQ ID NO: 3570
  Description of Artificial Sequence: Synthetic Heavy chain variable region amino acid sequence

SEQ ID NO: 3635 - protein, 9 aa, Artificial Sequence
  Description of Artificial Sequence: Synthetic Heavy chain variable region CDR H1 amino acid sequence
FNIKDYYMH

SEQ ID NO: 3636 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3637 - protein, 17 aa, Artificial Sequence
  Description of Artificial Sequence: Synthetic Heavy chain variable region CDR H2 amino acid sequence
WIDLENGNTIYDPKFQG

SEQ ID NO: 3638 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 3639 - protein, 12 aa, Artificial Sequence
  Description of Artificial Sequence: Synthetic Heavy chain variable region CDR H3 amino acid sequence
ARDGYARYYFDY

SEQ ID NO: 3640 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3641 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcaatcttattctcggagaactttcggcggagggaccaaggttgagatcaaa

SEQ ID NO: 3642 - protein, 112 aa, Artificial Sequence
  Description of Artificial Sequence: Synthetic Light chain variable region amino acid sequence
DIVMTQSPDSLAVSLGERATINCKSSQSLLNSRTRKNYLAWYQQKPGQPPKLLIYWASTRESGVPDRFSGSGSGTDFTLTISSLQAEDVAVYYCKQSYSRRTFGGGTKVEIK

SEQ ID NO: 3643 - protein, 17 aa, Artificial Sequence
  Description of Artificial Sequence: Synthetic Light chain variable region CDR L1 amino acid sequence
KSSQSLLNSRTRKNYLA

SEQ ID NO: 3644 - DNA, 51 bp, Artificial Sequence; identical to SEQ ID NO: 2988
  Description of Artificial Sequence: Synthetic Light chain variable region CDR L1 nucleic acid sequence

SEQ ID NO: 3645 - protein, 7 aa, Artificial Sequence
  Description of Artificial Sequence: Synthetic Light chain variable region CDR L2 amino acid sequence
WASTRES

SEQ ID NO: 3646 - DNA, 21 bp, Artificial Sequence
  Description of Artificial Sequence: Synthetic Light chain variable region CDR L2 nucleic acid sequence
tgggcatctacccgggaatcc

SEQ ID NO: 3647 - protein, 8 aa, Artificial Sequence
  Description of Artificial Sequence: Synthetic Light chain variable region CDR L3 amino acid sequence
KQSYSRRT

SEQ ID NO: 3648 - DNA, 24 bp, Artificial Sequence
  Description of Artificial Sequence: Synthetic Light chain variable region CDR L3 nucleic acid sequence
aagcaatcttattctcggagaact

SEQ ID NO: 3649 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggcccctggacaaaggcttgagtggatgggatggatcgaccttgaaaatggtaacacaatctatgacccgaaatttcagggcagggtcaccataaccagggacacgtccgccagcacagcctacatggagctgagcagcctgagatctgaagacacggcggtgtactactgcgcgagagatggatacgctagatattactttgactactggggccaaggaaccctggtcaccgtctcctca

SEQ ID NO: 3650 - protein, 119 aa, Artificial Sequence; identical to SEQ ID NO: 3570
  Description of Artificial Sequence: Synthetic Heavy chain variable region amino acid sequence

SEQ ID NO: 3651 - protein, 9 aa, Artificial Sequence
  Description of Artificial Sequence: Synthetic Heavy chain variable region CDR H1 amino acid sequence
FNIKDYYMH

SEQ ID NO: 3652 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3653 - protein, 17 aa, Artificial Sequence
  Description of Artificial Sequence: Synthetic Heavy chain variable region CDR H2 amino acid sequence
WIDLENGNTIYDPKFQG

SEQ ID NO: 3654 - DNA, 51 bp, Artificial Sequence; identical to SEQ ID NO: 3606
  Description of Artificial Sequence: Synthetic Heavy chain variable region CDR H2 nucleic acid sequence

SEQ ID NO: 3655 - protein, 12 aa, Artificial Sequence
  Description of Artificial Sequence: Synthetic Heavy chain variable region CDR H3 amino acid sequence
ARDGYARYYFDY

SEQ ID NO: 3656 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3657 - DNA, 336 bp, Artificial Sequence
  Description of Artificial Sequence: Synthetic Light chain variable region nucleic acid sequence
gacatcgtgatgacccagtctccagactccctggctgtgtctctgggcgggagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctcggagaactttcggcggagggaccaaggtcgagatcaaa

SEQ ID NO: 3658 - protein, 112 aa, Artificial Sequence
  Description of Artificial Sequence: Synthetic Light chain variable region amino acid sequence
DIVMTQSPDSLAVSLGGRATINCKSSQSLLNSRTRKNYLAWYQQKPGQPPKLLIYWASTRESGVPDRFSGSGSGTDFTLTISSLQAEDVAVYYCKQSYSRRTFGGGTKVEIK

SEQ ID NO: 3659 - protein, 17 aa, Artificial Sequence
  Description of Artificial Sequence: Synthetic Light chain variable region CDR L1 amino acid sequence
KSSQSLLNSRTRKNYLA

SEQ ID NO: 3660 - DNA, 51 bp, Artificial Sequence; identical to SEQ ID NO: 2988
  Description of Artificial Sequence: Synthetic Light chain variable region CDR L1 nucleic acid sequence

SEQ ID NO: 3661 - protein, 7 aa, Artificial Sequence
  Description of Artificial Sequence: Synthetic Light chain variable region CDR L2 amino acid sequence
WASTRES

SEQ ID NO: 3662 - DNA, 21 bp, Artificial Sequence
  Description of Artificial Sequence: Synthetic Light chain variable region CDR L2 nucleic acid sequence
tgggcatctacccgggaatcc

SEQ ID NO: 3663 - protein, 8 aa, Artificial Sequence
  Description of Artificial Sequence: Synthetic Light chain variable region CDR L3 amino acid sequence
KQSYSRRT

SEQ ID NO: 3664 - DNA, 24 bp, Artificial Sequence
  Description of Artificial Sequence: Synthetic Light chain variable region CDR L3 nucleic acid sequence
aagcaatcttattctcggagaact

SEQ ID NO: 3665 - DNA, 357 bp, Artificial Sequence; identical to SEQ ID NO: 3585
  Description of Artificial Sequence: Synthetic Heavy chain variable region nucleic acid sequence

SEQ ID NO: 3666 - protein, 119 aa, Artificial Sequence; identical to SEQ ID NO: 3586
  Description of Artificial Sequence: Synthetic Heavy chain variable region amino acid sequence

SEQ ID NO: 3667 - protein, 9 aa, Artificial Sequence
  Description of Artificial Sequence: Synthetic Heavy chain variable region CDR H1 amino acid sequence
FNTKDYYMH

SEQ ID NO: 3668 - DNA, 27 bp, Artificial Sequence
  Description of Artificial Sequence: Synthetic Heavy chain variable region CDR H1 nucleic acid sequence
ttcaacaccaaggactactatatgcac

SEQ ID NO: 3669 - protein, 17 aa, Artificial Sequence
  Description of Artificial Sequence: Synthetic Heavy chain variable region CDR H2 amino acid sequence
WIGPENGNTIYDPKFQG

SEQ ID NO: 3670 - DNA, 51 bp, Artificial Sequence; identical to SEQ ID NO: 3590
  Description of Artificial Sequence: Synthetic Heavy chain variable region CDR H2 nucleic acid sequence

SEQ ID NO: 3671 - protein, 12 aa, Artificial Sequence
  Description of Artificial Sequence: Synthetic Heavy chain variable region CDR H3 amino acid sequence
ARDGYARYYFDY

SEQ ID NO: 3672 - DNA, 36 bp, Artificial Sequence; identical to SEQ ID NO: 3592
  Description of Artificial Sequence: Synthetic Heavy chain variable region CDR H3 nucleic acid sequence

SEQ ID NO: 3673 - DNA, 336 bp, Artificial Sequence
  Description of Artificial Sequence: Synthetic Light chain variable region nucleic acid sequence
gacatcgtgatgacccagtctccagactccctggctgtgcctctgggcgagagggccaccatcaactgcaagtccagccagagccttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcaatcttattctcggagaactttcggcggagggaccaaggttgagatcaaa

SEQ ID NO: 3674 - protein, 112 aa, Artificial Sequence
  Description of Artificial Sequence: Synthetic Light chain variable region amino acid sequence
DIVMTQSPDSLAVPLGERATINCKSSQSLLNSRTRKNYLAWYQQKPGQPPKLLIYWASTRESGVPDRFSGSGSGTDFTLTISSLQAEDVAVYYCKQSYSRRTFGGGTKVEIK

SEQ ID NO: 3675 - protein, 17 aa, Artificial Sequence
  Description of Artificial Sequence: Synthetic Light chain variable region CDR L1 amino acid sequence
KSSQSLLNSRTRKNYLA

SEQ ID NO: 3676 - DNA, 51 bp, Artificial Sequence
  Description of Artificial Sequence: Synthetic Light chain variable region CDR L1 nucleic acid sequence
aagtccagccagagccttttaaacagcagaaccagaaagaactacttagct

SEQ ID NO: 3677 - protein, 7 aa, Artificial Sequence
  Description of Artificial Sequence: Synthetic Light chain variable region CDR L2 amino acid sequence
WASTRES

SEQ ID NO: 3678 - DNA, 21 bp, Artificial Sequence
  Description of Artificial Sequence: Synthetic Light chain variable region CDR L2 nucleic acid sequence
tgggcatctacccgggaatcc

SEQ ID NO: 3679 - protein, 8 aa, Artificial Sequence
  Description of Artificial Sequence: Synthetic Light chain variable region CDR L3 amino acid sequence
KQSYSRRT

SEQ ID NO: 3680 - DNA, 24 bp, Artificial Sequence
  Description of Artificial Sequence: Synthetic Light chain variable region CDR L3 nucleic acid sequence
aagcaatcttattctcggagaact

SEQ ID NO: 3681 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcttctggattcaacatcaaggactactatatgcactgggtgcgacaggcccctggacaaaggcttgagtggatgggatggatcgaccttgaaaatggtaacacaatctatgacccgaaatttcagggcagggtcaccataaccagggacacgtccgccagcacagcctacatggagctgagcagcctgagatctgaagacacggcggtgtactactgcgcgagagatggatacgctagatattactttgactactggggccaaggaaccctggtcaccgtctcctca

SEQ ID NO: 3682 - protein, 119 aa, Artificial Sequence; identical to SEQ ID NO: 3570
  Description of Artificial Sequence: Synthetic Heavy chain variable region amino acid sequence

SEQ ID NO: 3683 - protein, 9 aa, Artificial Sequence
  Description of Artificial Sequence: Synthetic Heavy chain variable region CDR H1 amino acid sequence
FNIKDYYMH

SEQ ID NO: 3684 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3685 - protein, 17 aa, Artificial Sequence
  Description of Artificial Sequence: Synthetic Heavy chain variable region CDR H2 amino acid sequence
WIDLENGNTIYDPKFQG

SEQ ID NO: 3686 - DNA, 51 bp, Artificial Sequence; identical to SEQ ID NO: 3606
  Description of Artificial Sequence: Synthetic Heavy chain variable region CDR H2 nucleic acid sequence

SEQ ID NO: 3687 - protein, 12 aa, Artificial Sequence
  Description of Artificial Sequence: Synthetic Heavy chain variable region CDR H3 amino acid sequence
ARDGYARYYFDY

SEQ ID NO: 3688 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3689 - DNA, 336 bp, Artificial Sequence
  Description of Artificial Sequence: Synthetic Light chain variable region nucleic acid sequence
gacatcgtaatgacccagtctccagactccctggctgtgtctctgggcgagagggccaccatcaactgcaggtccagccagagtcttttaaacagcagaaccagaaagaactacttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtaagcaatcttattctcggagaactttcggcggagggaccaaggttgagatcaaa

SEQ ID NO: 3690 - protein, 112 aa, Artificial Sequence
  Description of Artificial Sequence: Synthetic Light chain variable region amino acid sequence
DIVMTQSPDSLAVSLGERATINCRSSQSLLNSRTRKNYLAWYQQKPGQPPKLLIYWASIRESGVPDRFSGSGSGTDFTLTISSLQAEDVAVYYCKQSYSRRTFGGGTKVEIK

SEQ ID NO: 3691 - protein, 17 aa, Artificial Sequence
  Description of Artificial Sequence: Synthetic Light chain variable region CDR L1 amino acid sequence
RSSQSLLNSRTRKNYLA

SEQ ID NO: 3692 - DNA, 51 bp, Artificial Sequence; identical to SEQ ID NO: 3596
  Description of Artificial Sequence: Synthetic Light chain variable region CDR L1 nucleic acid sequence

SEQ ID NO: 3693 - protein, 7 aa, Artificial Sequence
  Description of Artificial Sequence: Synthetic Light chain variable region CDR L2 amino acid sequence
WASIRES

SEQ ID NO: 3694 - DNA, 21 bp, Artificial Sequence
  Description of Artificial Sequence: Synthetic Light chain variable region CDR L2 nucleic acid sequence
tgggcatctatccgggaatcc

SEQ ID NO: 3695 - protein, 8 aa, Artificial Sequence
  Description of Artificial Sequence: Synthetic Light chain variable region CDR L3 amino acid sequence
KQSYSRRT

SEQ ID NO: 3696 - DNA, 24 bp, Artificial Sequence
  Description of Artificial Sequence: Synthetic Light chain variable region CDR L3 nucleic acid sequence
aagcaatcttattctcggagaact

SEQ ID NO: 3697 - DNA, 357 bp, Artificial Sequence; identical to SEQ ID NO: 3569
  Description of Artificial Sequence: Synthetic Heavy chain variable region nucleic acid sequence

SEQ ID NO: 3698 - protein, 119 aa, Artificial Sequence; identical to SEQ ID NO: 3570
  Description of Artificial Sequence: Synthetic Heavy chain variable region amino acid sequence

SEQ ID NO: 3699 - protein, 9 aa, Artificial Sequence
  Description of Artificial Sequence: Synthetic Heavy chain variable region CDR H1 amino acid sequence
FNIKDYYMH

SEQ ID NO: 3700 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3701 - protein, 17 aa, Artificial Sequence
  Description of Artificial Sequence: Synthetic Heavy chain variable region CDR H2 amino acid sequence
WIDLENGNTIYDPKFQG

SEQ ID NO: 3702 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 3703 - protein, 12 aa, Artificial Sequence
  Description of Artificial Sequence: Synthetic Heavy chain variable region CDR H3 amino acid sequence
ARDGYARYYFDY

SEQ ID NO: 3704 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3705 - DNA, 336 bp, Artificial Sequence; identical to SEQ ID NO: 3577
  Description of Artificial Sequence: Synthetic Light chain variable region nucleic acid sequence

SEQ ID NO: 3706 - protein, 112 aa, Artificial Sequence; identical to SEQ ID NO: 3578
  Description of Artificial Sequence: Synthetic Light chain variable region amino acid sequence

SEQ ID NO: 3707 - protein, 17 aa, Artificial Sequence
  Description of Artificial Sequence: Synthetic Light chain variable region CDR L1 amino acid sequence
KSSQSLLNSRTRKNYLA

SEQ ID NO: 3708 - DNA, 51 bp, Artificial Sequence; identical to SEQ ID NO: 2988
  Description of Artificial Sequence: Synthetic Light chain variable region CDR L1 nucleic acid sequence

SEQ ID NO: 3709 - protein, 7 aa, Artificial Sequence
  Description of Artificial Sequence: Synthetic Light chain variable region CDR L2 amino acid sequence
WASTRES

SEQ ID NO: 3710 - DNA, 21 bp, Artificial Sequence
  Description of Artificial Sequence: Synthetic Light chain variable region CDR L2 nucleic acid sequence
tgggcatctacccgggaatcc

SEQ ID NO: 3711 - protein, 8 aa, Artificial Sequence
  Description of Artificial Sequence: Synthetic Light chain variable region CDR L3 amino acid sequence
KQSYFRRA

SEQ ID NO: 3712 - DNA, 24 bp, Artificial Sequence
  Description of Artificial Sequence: Synthetic Light chain variable region CDR L3 nucleic acid sequence
aagcaatcttattttcggagagct

SEQ ID NO: 3713 - DNA, 357 bp, Artificial Sequence; identical to SEQ ID NO: 3649
  Description of Artificial Sequence: Synthetic Heavy chain variable region nucleic acid sequence

SEQ ID NO: 3714 - protein, 119 aa, Artificial Sequence; identical to SEQ ID NO: 3570
  Description of Artificial Sequence: Synthetic Heavy chain variable region amino acid sequence

SEQ ID NO: 3715 - protein, 9 aa, Artificial Sequence
  Description of Artificial Sequence: Synthetic Heavy chain variable region CDR H1 amino acid sequence
FNIKDYYMH

SEQ ID NO: 3716 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3717 - protein, 17 aa, Artificial Sequence
  Description of Artificial Sequence: Synthetic Heavy chain variable region CDR H2 amino acid sequence
WIDLENGNTIYDPKFQG

SEQ ID NO: 3718 - DNA, 51 bp, Artificial Sequence; identical to SEQ ID NO: 3606
  Description of Artificial Sequence: Synthetic Heavy chain variable region CDR H2 nucleic acid sequence

SEQ ID NO: 3719 - protein, 12 aa, Artificial Sequence
  Description of Artificial Sequence: Synthetic Heavy chain variable region CDR H3 amino acid sequence
ARDGYARYYFDY

SEQ ID NO: 3720 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3721 - DNA, 336 bp, Artificial Sequence; identical to SEQ ID NO: 3593
  Description of Artificial Sequence: Synthetic Light chain variable region nucleic acid sequence

SEQ ID NO: 3722 - protein, 112 aa, Artificial Sequence; identical to SEQ ID NO: 3594
  Description of Artificial Sequence: Synthetic Light chain variable region amino acid sequence

SEQ ID NO: 3723 - protein, 17 aa, Artificial Sequence
  Description of Artificial Sequence: Synthetic Light chain variable region CDR L1 amino acid sequence
RSSQSLLNSRTRKNYLA

SEQ ID NO: 3724 - DNA, 51 bp, Artificial Sequence; identical to SEQ ID NO: 3596
  Description of Artificial Sequence: Synthetic Light chain variable region CDR L1 nucleic acid sequence

SEQ ID NO: 3725 - protein, 7 aa, Artificial Sequence
  Description of Artificial Sequence: Synthetic Light chain variable region CDR L2 amino acid sequence
WASTRES

SEQ ID NO: 3726 - DNA, 21 bp, Artificial Sequence
  Description of Artificial Sequence: Synthetic Light chain variable region CDR L2 nucleic acid sequence
tgggcatctacccgggaatcc

SEQ ID NO: 3727 - protein, 8 aa, Artificial Sequence
  Description of Artificial Sequence: Synthetic Light chain variable region CDR L3 amino acid sequence
KQSYSRRT

SEQ ID NO: 3728 - DNA, 24 bp, Artificial Sequence
  Description of Artificial Sequence: Synthetic Light chain variable region CDR L3 nucleic acid sequence
aagcaatcttattctcggagaact

SEQ ID NO: 3729 - DNA, 357 bp, Artificial Sequence; identical to SEQ ID NO: 3569
  Description of Artificial Sequence: Synthetic Heavy chain variable region nucleic acid sequence

SEQ ID NO: 3730 - protein, 119 aa, Artificial Sequence; identical to SEQ ID NO: 3570
  Description of Artificial Sequence: Synthetic Heavy chain variable region amino acid sequence

SEQ ID NO: 3731 - protein, 9 aa, Artificial Sequence
  Description of Artificial Sequence: Synthetic Heavy chain variable region CDR H1 amino acid sequence
FNIKDYYMH

SEQ ID NO: 3732 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3733 - protein, 17 aa, Artificial Sequence
  Description of Artificial Sequence: Synthetic Heavy chain variable region CDR H2 amino acid sequence
WIDLENGNTIYDPKFQG

SEQ ID NO: 3734 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 3735 - protein, 12 aa, Artificial Sequence
  Description of Artificial Sequence: Synthetic Heavy chain variable region CDR H3 amino acid sequence
ARDGYARYYFDY

SEQ ID NO: 3736 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3737 - DNA, 336 bp, Artificial Sequence
  Description of Artificial Sequence: Synthetic Light chain variable region nucleic acid sequence
ggcatcgtgatgacccagtctccagactccctggctgtgtctctgggcgagagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcaatcttattctcggagaactttcggcggagggaccaaggtcgagatcaaa

SEQ ID NO: 3738 - protein, 112 aa, Artificial Sequence
  Description of Artificial Sequence: Synthetic Light chain variable region amino acid sequence
GIVMTQSPDSLAVSLGERATINCKSSQSLLNSRTRKNYLAWYQQKPGQPPKLLIYWASTRESGVPDRFSGSGSGTDFTLTISSLQAEDVAVYYCKQSYSRRTFGGGTKVEIK

SEQ ID NO: 3739 - protein, 17 aa, Artificial Sequence
  Description of Artificial Sequence: Synthetic Light chain variable region CDR L1 amino acid sequence
KSSQSLLNSRTRKNYLA

SEQ ID NO: 3740 - DNA, 51 bp, Artificial Sequence; identical to SEQ ID NO: 2988
  Description of Artificial Sequence: Synthetic Light chain variable region CDR L1 nucleic acid sequence

SEQ ID NO: 3741 - protein, 7 aa, Artificial Sequence
  Description of Artificial Sequence: Synthetic Light chain variable region CDR L2 amino acid sequence
WASTRES

SEQ ID NO: 3742 - DNA, 21 bp, Artificial Sequence
  Description of Artificial Sequence: Synthetic Light chain variable region CDR L2 nucleic acid sequence
tgggcatctacccgggaatcc

SEQ ID NO: 3743 - protein, 8 aa, Artificial Sequence
  Description of Artificial Sequence: Synthetic Light chain variable region CDR L3 amino acid sequence
KQSYSRRT

SEQ ID NO: 3744 - DNA, 24 bp, Artificial Sequence
  Description of Artificial Sequence: Synthetic Light chain variable region CDR L3 nucleic acid sequence
aagcaatcttattctcggagaact

SEQ ID NO: 3745 - DNA, 357 bp, Artificial Sequence; identical to SEQ ID NO: 3649
  Description of Artificial Sequence: Synthetic Heavy chain variable region nucleic acid sequence

SEQ ID NO: 3746 - protein, 119 aa, Artificial Sequence; identical to SEQ ID NO: 3570
  Description of Artificial Sequence: Synthetic Heavy chain variable region amino acid sequence

SEQ ID NO: 3747 - protein, 9 aa, Artificial Sequence
  Description of Artificial Sequence: Synthetic Heavy chain variable region CDR H1 amino acid sequence
FNIKDYYMH

SEQ ID NO: 3748 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3749 - protein, 17 aa, Artificial Sequence
  Description of Artificial Sequence: Synthetic Heavy chain variable region CDR H2 amino acid sequence
WIDLENGNTIYDPKFQG

SEQ ID NO: 3750 - DNA, 51 bp, Artificial Sequence; identical to SEQ ID NO: 3606
  Description of Artificial Sequence: Synthetic Heavy chain variable region CDR H2 nucleic acid sequence

SEQ ID NO: 3751 - protein, 12 aa, Artificial Sequence
  Description of Artificial Sequence: Synthetic Heavy chain variable region CDR H3 amino acid sequence
ARDGYARYYFDY

SEQ ID NO: 3752 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3753 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacggcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcaatcttattctcggagaactttcggcggagggaccaaggttgagatcaaa

SEQ ID NO: 3754 - protein, 112 aa, Artificial Sequence
  Description of Artificial Sequence: Synthetic Light chain variable region amino acid sequence
DIVMTQSPDSLAVSLGERATINCKSSQSLLNGRTRKNYLAWYQQKPGQPPKLLIYWASTRESGVPDRFSGSGSGTDFTLTISSLQAEDVAVYYCKQSYSRRTFGGGTKVEIK

SEQ ID NO: 3755 - protein, 17 aa, Artificial Sequence
  Description of Artificial Sequence: Synthetic Light chain variable region CDR L1 amino acid sequence
KSSQSLLNGRTRKNYLA

SEQ ID NO: 3756 - DNA, 51 bp, Artificial Sequence; identical to SEQ ID NO: 3612
  Description of Artificial Sequence: Synthetic Light chain variable region CDR L1 nucleic acid sequence

SEQ ID NO: 3757 - protein, 7 aa, Artificial Sequence
  Description of Artificial Sequence: Synthetic Light chain variable region CDR L2 amino acid sequence
WASTRES

SEQ ID NO: 3758 - DNA, 21 bp, Artificial Sequence
  Description of Artificial Sequence: Synthetic Light chain variable region CDR L2 nucleic acid sequence
tgggcatctacccgggaatcc

SEQ ID NO: 3759 - protein, 8 aa, Artificial Sequence
  Description of Artificial Sequence: Synthetic Light chain variable region CDR L3 amino acid sequence
KQSYSRRT

SEQ ID NO: 3760 - DNA, 24 bp, Artificial Sequence
  Description of Artificial Sequence: Synthetic Light chain variable region CDR L3 nucleic acid sequence
aagcaatcttattctcggagaact

SEQ ID NO: 3761 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggcccctggacaaaggcttgagtggatgggatggatcgaccttgacaatggtaacacaatctatgacccgaaatttcagggcagggtcaccataaccagggacacgtccgccagcacagcctacatggagctgagcagcctgagatctgaagacacggcggtgtactactgcgcgagagatggatacgctagatattactttgactactggggccaaggaaccctggtcaccgtctcctca

SEQ ID NO: 3762 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLDNGNTIYDPKFQGRVTITRDTSASTAYMELSSLRSEDTAVYYCARDGYARYYFDYWGQGTLVTVSS

SEQ ID NO: 3763 - protein, 9 aa, Artificial Sequence
  Description of Artificial Sequence: Synthetic Heavy chain variable region CDR H1 amino acid sequence
FNIKDYYMH

SEQ ID NO: 3764 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3765 - protein, 17 aa, Artificial Sequence
  Description of Artificial Sequence: Synthetic Heavy chain variable region CDR H2 amino acid sequence
WIDLDNGNTIYDPKFQG

SEQ ID NO: 3766 - DNA, 51 bp, Artificial Sequence
  Description of Artificial Sequence: Synthetic Heavy chain variable region CDR H2 nucleic acid sequence
tggatcgaccttgacaatggtaacacaatctatgacccgaaatttcagggc

SEQ ID NO: 3767 - protein, 12 aa, Artificial Sequence
  Description of Artificial Sequence: Synthetic Heavy chain variable region CDR H3 amino acid sequence
ARDGYARYYFDY

SEQ ID NO: 3768 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3769 - DNA, 336 bp, Artificial Sequence; identical to SEQ ID NO: 3673
  Description of Artificial Sequence: Synthetic Light chain variable region nucleic acid sequence

SEQ ID NO: 3770 - protein, 112 aa, Artificial Sequence; identical to SEQ ID NO: 3674
  Description of Artificial Sequence: Synthetic Light chain variable region amino acid sequence

SEQ ID NO: 3771 - protein, 17 aa, Artificial Sequence
  Description of Artificial Sequence: Synthetic Light chain variable region CDR L1 amino acid sequence
KSSQSLLNSRTRKNYLA

SEQ ID NO: 3772 - DNA, 51 bp, Artificial Sequence; identical to SEQ ID NO: 3676
  Description of Artificial Sequence: Synthetic Light chain variable region CDR L1 nucleic acid sequence

SEQ ID NO: 3773 - protein, 7 aa, Artificial Sequence
  Description of Artificial Sequence: Synthetic Light chain variable region CDR L2 amino acid sequence
WASTRES

SEQ ID NO: 3774 - DNA, 21 bp, Artificial Sequence
  Description of Artificial Sequence: Synthetic Light chain variable region CDR L2 nucleic acid sequence
tgggcatctacccgggaatcc

SEQ ID NO: 3775 - protein, 8 aa, Artificial Sequence
  Description of Artificial Sequence: Synthetic Light chain variable region CDR L3 amino acid sequence
KQSYSRRT

SEQ ID NO: 3776 - DNA, 24 bp, Artificial Sequence
  Description of Artificial Sequence: Synthetic Light chain variable region CDR L3 nucleic acid sequence
aagcaatcttattctcggagaact

SEQ ID NO: 3777 - DNA, 357 bp, Artificial Sequence; identical to SEQ ID NO: 3601
  Description of Artificial Sequence: Synthetic Heavy chain variable region nucleic acid sequence

SEQ ID NO: 3778 - protein, 119 aa, Artificial Sequence; identical to SEQ ID NO: 3570
  Description of Artificial Sequence: Synthetic Heavy chain variable region amino acid sequence

SEQ ID NO: 3779 - protein, 9 aa, Artificial Sequence
  Description of Artificial Sequence: Synthetic Heavy chain variable region CDR H1 amino acid sequence
FNIKDYYMH

SEQ ID NO: 3780 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3781 - protein, 17 aa, Artificial Sequence
  Description of Artificial Sequence: Synthetic Heavy chain variable region CDR H2 amino acid sequence
WIDLENGNTIYDPKFQG

SEQ ID NO: 3782 - DNA, 51 bp, Artificial Sequence; identical to SEQ ID NO: 3606
  Description of Artificial Sequence: Synthetic Heavy chain variable region CDR H2 nucleic acid sequence

SEQ ID NO: 3783 - protein, 12 aa, Artificial Sequence
  Description of Artificial Sequence: Synthetic Heavy chain variable region CDR H3 amino acid sequence
ARDGYARYYFDY

SEQ ID NO: 3784 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3785 - DNA, 336 bp, Artificial Sequence; identical to SEQ ID NO: 3609
  Description of Artificial Sequence: Synthetic Light chain variable region nucleic acid sequence

SEQ ID NO: 3786 - protein, 112 aa, Artificial Sequence; identical to SEQ ID NO: 3610
  Description of Artificial Sequence: Synthetic Light chain variable region amino acid sequence

SEQ ID NO: 3787 - protein, 17 aa, Artificial Sequence
  Description of Artificial Sequence: Synthetic Light chain variable region CDR L1 amino acid sequence
KSSQSLLNGRTRKNYLA

SEQ ID NO: 3788 - DNA, 51 bp, Artificial Sequence; identical to SEQ ID NO: 3612
  Description of Artificial Sequence: Synthetic Light chain variable region CDR L1 nucleic acid sequence

SEQ ID NO: 3789 - protein, 7 aa, Artificial Sequence
  Description of Artificial Sequence: Synthetic Light chain variable region CDR L2 amino acid sequence
WASTRES

SEQ ID NO: 3790 - DNA, 21 bp, Artificial Sequence
  Description of Artificial Sequence: Synthetic Light chain variable region CDR L2 nucleic acid sequence
tgggcatctacccgggaatcc

SEQ ID NO: 3791 - protein, 8 aa, Artificial Sequence
  Description of Artificial Sequence: Synthetic Light chain variable region CDR L3 amino acid sequence
KQSYSRRT

SEQ ID NO: 3792 - DNA, 24 bp, Artificial Sequence
  Description of Artificial Sequence: Synthetic Light chain variable region CDR L3 nucleic acid sequence
aagcaatcttattctcggagaact

SEQ ID NO: 3793 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggcccctggacaaaggcttgagtggatgggatggatcgaccttgaaaatggtaacacaatctatgacccgaaatttcagggcagggtcaccataaccaggaacacgtccgccagcacagcctacatggagctgagcagcctgagatctgaagacacggcggtgtactactgcgcgagagatggatacgctagatattactttgactactggggccaaggaaccctggtcaccgtttcctca

SEQ ID NO: 3794 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRNTSASTAYMELSSLRSEDTAVYYCARDGYARYYFDYWGQGTLVTVSS

SEQ ID NO: 3795 - protein, 9 aa, Artificial Sequence
  Description of Artificial Sequence: Synthetic Heavy chain variable region CDR H1 amino acid sequence
FNIKDYYMH

SEQ ID NO: 3796 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3797 - protein, 17 aa, Artificial Sequence
  Description of Artificial Sequence: Synthetic Heavy chain variable region CDR H2 amino acid sequence
WIDLENGNTIYDPKFQG

SEQ ID NO: 3798 - DNA, 51 bp, Artificial Sequence; identical to SEQ ID NO: 3606
  Description of Artificial Sequence: Synthetic Heavy chain variable region CDR H2 nucleic acid sequence

SEQ ID NO: 3799 - protein, 12 aa, Artificial Sequence
  Description of Artificial Sequence: Synthetic Heavy chain variable region CDR H3 amino acid sequence
ARDGYARYYFDY

SEQ ID NO: 3800 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3801 - DNA, 336 bp, Artificial Sequence; identical to SEQ ID NO: 3641
  Description of Artificial Sequence: Synthetic Light chain variable region nucleic acid sequence

SEQ ID NO: 3802 - protein, 112 aa, Artificial Sequence; identical to SEQ ID NO: 3642
  Description of Artificial Sequence: Synthetic Light chain variable region amino acid sequence

SEQ ID NO: 3803 - protein, 17 aa, Artificial Sequence
  Description of Artificial Sequence: Synthetic Light chain variable region CDR L1 amino acid sequence
KSSQSLLNSRTRKNYLA

SEQ ID NO: 3804 - DNA, 51 bp, Artificial Sequence; identical to SEQ ID NO: 2988
  Description of Artificial Sequence: Synthetic Light chain variable region CDR L1 nucleic acid sequence

SEQ ID NO: 3805 - protein, 7 aa, Artificial Sequence
  Description of Artificial Sequence: Synthetic Light chain variable region CDR L2 amino acid sequence
WASTRES

SEQ ID NO: 3806 - DNA, 21 bp, Artificial Sequence
  Description of Artificial Sequence: Synthetic Light chain variable region CDR L2 nucleic acid sequence
tgggcatctacccgggaatcc

SEQ ID NO: 3807 - protein, 8 aa, Artificial Sequence
  Description of Artificial Sequence: Synthetic Light chain variable region CDR L3 amino acid sequence
KQSYSRRT

SEQ ID NO: 3808 - DNA, 24 bp, Artificial Sequence
  Description of Artificial Sequence: Synthetic Light chain variable region CDR L3 nucleic acid sequence
aagcaatcttattctcggagaact

SEQ ID NO: 3809 - DNA, 357 bp, Artificial Sequence; identical to SEQ ID NO: 3569
  Description of Artificial Sequence: Synthetic Heavy chain variable region nucleic acid sequence

SEQ ID NO: 3810 - protein, 119 aa, Artificial Sequence; identical to SEQ ID NO: 3570
  Description of Artificial Sequence: Synthetic Heavy chain variable region amino acid sequence

SEQ ID NO: 3811 - protein, 9 aa, Artificial Sequence
  Description of Artificial Sequence: Synthetic Heavy chain variable region CDR H1 amino acid sequence
FNIKDYYMH

SEQ ID NO: 3812 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3813 - protein, 17 aa, Artificial Sequence
  Description of Artificial Sequence: Synthetic Heavy chain variable region CDR H2 amino acid sequence
WIDLENGNTIYDPKFQG

SEQ ID NO: 3814 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 3815 - protein, 12 aa, Artificial Sequence
  Description of Artificial Sequence: Synthetic Heavy chain variable region CDR H3 amino acid sequence
ARDGYARYYFDY

SEQ ID NO: 3816 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3817 - DNA, 336 bp, Artificial Sequence; identical to SEQ ID NO: 3673
  Description of Artificial Sequence: Synthetic Light chain variable region nucleic acid sequence

SEQ ID NO: 3818 - protein, 112 aa, Artificial Sequence; identical to SEQ ID NO: 3674
  Description of Artificial Sequence: Synthetic Light chain variable region amino acid sequence

SEQ ID NO: 3819 - protein, 17 aa, Artificial Sequence
  Description of Artificial Sequence: Synthetic Light chain variable region CDR L1 amino acid sequence
KSSQSLLNSRTRKNYLA

SEQ ID NO: 3820 - DNA, 51 bp, Artificial Sequence; identical to SEQ ID NO: 3676
  Description of Artificial Sequence: Synthetic Light chain variable region CDR L1 nucleic acid sequence

SEQ ID NO: 3821 - protein, 7 aa, Artificial Sequence
  Description of Artificial Sequence: Synthetic Light chain variable region CDR L2 amino acid sequence
WASTRES

SEQ ID NO: 3822 - DNA, 21 bp, Artificial Sequence
  Description of Artificial Sequence: Synthetic Light chain variable region CDR L2 nucleic acid sequence
tgggcatctacccgggaatcc

SEQ ID NO: 3823 - protein, 8 aa, Artificial Sequence
  Description of Artificial Sequence: Synthetic Light chain variable region CDR L3 amino acid sequence
KQSYSRRT

SEQ ID NO: 3824 - DNA, 24 bp, Artificial Sequence
  Description of Artificial Sequence: Synthetic Light chain variable region CDR L3 nucleic acid sequence
aagcaatcttattctcggagaact

SEQ ID NO: 3825 - DNA, 357 bp, Artificial Sequence; identical to SEQ ID NO: 3569
  Description of Artificial Sequence: Synthetic Heavy chain variable region nucleic acid sequence

SEQ ID NO: 3826 - protein, 119 aa, Artificial Sequence; identical to SEQ ID NO: 3570
  Description of Artificial Sequence: Synthetic Heavy chain variable region amino acid sequence

SEQ ID NO: 3827 - protein, 9 aa, Artificial Sequence
  Description of Artificial Sequence: Synthetic Heavy chain variable region CDR H1 amino acid sequence
FNIKDYYMH

SEQ ID NO: 3828 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3829 - protein, 17 aa, Artificial Sequence
  Description of Artificial Sequence: Synthetic Heavy chain variable region CDR H2 amino acid sequence
WIDLENGNTIYDPKFQG

SEQ ID NO: 3830 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 3831 - protein, 12 aa, Artificial Sequence
  Description of Artificial Sequence: Synthetic Heavy chain variable region CDR H3 amino acid sequence
ARDGYARYYFDY

SEQ ID NO: 3832 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3833 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcaatcttattctcggagaactttcggcggagggaccaaggtggagatcaaa

SEQ ID NO: 3834 - protein, 112 aa, Artificial Sequence; identical to SEQ ID NO: 3642
  Description of Artificial Sequence: Synthetic Light chain variable region amino acid sequence

SEQ ID NO: 3835 - protein, 17 aa, Artificial Sequence
  Description of Artificial Sequence: Synthetic Light chain variable region CDR L1 amino acid sequence
KSSQSLLNSRTRKNYLA

SEQ ID NO: 3836 - DNA, 51 bp, Artificial Sequence; identical to SEQ ID NO: 2988
  Description of Artificial Sequence: Synthetic Light chain variable region CDR L1 nucleic acid sequence

SEQ ID NO: 3837 - protein, 7 aa, Artificial Sequence
  Description of Artificial Sequence: Synthetic Light chain variable region CDR L2 amino acid sequence
WASTRES

SEQ ID NO: 3838 - DNA, 21 bp, Artificial Sequence
  Description of Artificial Sequence: Synthetic Light chain variable region CDR L2 nucleic acid sequence
tgggcatctacccgggaatcc

SEQ ID NO: 3839 - protein, 8 aa, Artificial Sequence
  Description of Artificial Sequence: Synthetic Light chain variable region CDR L3 amino acid sequence
KQSYSRRT

SEQ ID NO: 3840 - DNA, 24 bp, Artificial Sequence
  Description of Artificial Sequence: Synthetic Light chain variable region CDR L3 nucleic acid sequence
aagcaatcttattctcggagaact

SEQ ID NO: 3841 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggactcaacatcaaggactactatatgcactgggtgcgacaggcccctggacaaaggcttgagtggatgggatggatcggctctgaaaatggtaacacaatctatgacccgaagtttcagggcagggtcaccataaccagggacacgtccgccagcacagcctacatggagctgagcagcctgagatctgaggacacggcggtgtactactgcgcgagagatggatacgctagatattacttcgactactggggccaaggaaccctggtcaccgtctcctca

SEQ ID NO: 3842 - protein, 119 aa, Artificial Sequence
  Description of Artificial Sequence: Synthetic Heavy chain variable region amino acid sequence
QVQLVQSGAEVKKPGASVKVSCKASGLNIKDYYMHWVRQAPGQRLEWMGWIGSENGNTIYDPKFQGRVTITRDTSASTAYMELSSLRSEDTAVYYCARDGYARYYFDYWGQGTLVTVSS

SEQ ID NO: 3843 - protein, 9 aa, Artificial Sequence
  Description of Artificial Sequence: Synthetic Heavy chain variable region CDR H1 amino acid sequence
LNIKDYYMH

SEQ ID NO: 3844 - DNA, 27 bp, Artificial Sequence
  Description of Artificial Sequence: Synthetic Heavy chain variable region CDR H1 nucleic acid sequence
ctcaacatcaaggactactatatgcac

SEQ ID NO: 3845 - protein, 17 aa, Artificial Sequence
  Description of Artificial Sequence: Synthetic Heavy chain variable region CDR H2 amino acid sequence
WIGSENGNTIYDPKFQG

SEQ ID NO: 3846 - DNA, 51 bp, Artificial Sequence
  Description of Artificial Sequence: Synthetic Heavy chain variable region CDR H2 nucleic acid sequence
tggatcggctctgaaaatggtaacacaatctatgacccgaagtttcagggc

SEQ ID NO: 3847 - protein, 12 aa, Artificial Sequence
  Description of Artificial Sequence: Synthetic Heavy chain variable region CDR H3 amino acid sequence
ARDGYARYYFDY

SEQ ID NO: 3848 - DNA, 36 bp, Artificial Sequence
  Description of Artificial Sequence: Synthetic Heavy chain variable region CDR H3 nucleic acid sequence
gcgagagatggatacgctagatattacttcgactac

SEQ ID NO: 3849 - DNA, 336 bp, Artificial Sequence; identical to SEQ ID NO: 3673
  Description of Artificial Sequence: Synthetic Light chain variable region nucleic acid sequence

SEQ ID NO: 3850 - protein, 112 aa, Artificial Sequence; identical to SEQ ID NO: 3674
  Description of Artificial Sequence: Synthetic Light chain variable region amino acid sequence

SEQ ID NO: 3851 - protein, 17 aa, Artificial Sequence
  Description of Artificial Sequence: Synthetic Light chain variable region CDR L1 amino acid sequence
KSSQSLLNSRTRKNYLA

SEQ ID NO: 3852 - DNA, 51 bp, Artificial Sequence; identical to SEQ ID NO: 3676
  Description of Artificial Sequence: Synthetic Light chain variable region CDR L1 nucleic acid sequence

SEQ ID NO: 3853 - protein, 7 aa, Artificial Sequence
  Description of Artificial Sequence: Synthetic Light chain variable region CDR L2 amino acid sequence
WASTRES

SEQ ID NO: 3854 - DNA, 21 bp, Artificial Sequence
  Description of Artificial Sequence: Synthetic Light chain variable region CDR L2 nucleic acid sequence
tgggcatctacccgggaatcc

SEQ ID NO: 3855 - protein, 8 aa, Artificial Sequence
  Description of Artificial Sequence: Synthetic Light chain variable region CDR L3 amino acid sequence
KQSYSRRT

SEQ ID NO: 3856 - DNA, 24 bp, Artificial Sequence
  Description of Artificial Sequence: Synthetic Light chain variable region CDR L3 nucleic acid sequence
aagcaatcttattctcggagaact

SEQ ID NO: 3857 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggactcaacatcaaggactactatatgcactgggtgcgacaggcccctggacaaaggcttgagtggatgggatggatcgaccttgaaaatggtaacacaatctatgacccgaaatttcagggcagggtcaccataaccagggacacgtccgccagcacagcctacatggagctgagcagcctgagatctgaagacacggcggtgtactactgcgcgagagatggatacgctagatattactttgactactggggccaaggaaccctggtcaccgtctcctca

SEQ ID NO: 3858 - protein, 119 aa, Artificial Sequence
  Description of Artificial Sequence: Synthetic Heavy chain variable region amino acid sequence
QVQLVQSGAEVKKPGASVKVSCKASGLNIKDYYMHWVRQAPGQRLEWMGWIDLENGNTIYDPKFQGRVTITRDTSASTAYMELSSLRSEDTAVYYCARDGYARYYFDYWGQGTLVTVSS

SEQ ID NO: 3859 - protein, 9 aa, Artificial Sequence
  Description of Artificial Sequence: Synthetic Heavy chain variable region CDR H1 amino acid sequence
LNIKDYYMH

SEQ ID NO: 3860 - DNA, 27 bp, Artificial Sequence
  Description of Artificial Sequence: Synthetic Heavy chain variable region CDR H1 nucleic acid sequence
ctcaacatcaaggactactatatgcac

SEQ ID NO: 3861 - protein, 17 aa, Artificial Sequence
  Description of Artificial Sequence: Synthetic Heavy chain variable region CDR H2 amino acid sequence
WIDLENGNTIYDPKFQG

SEQ ID NO: 3862 - DNA, 51 bp, Artificial Sequence; identical to SEQ ID NO: 3606
  Description of Artificial Sequence: Synthetic Heavy chain variable region CDR H2 nucleic acid sequence

SEQ ID NO: 3863 - protein, 12 aa, Artificial Sequence
  Description of Artificial Sequence: Synthetic Heavy chain variable region CDR H3 amino acid sequence
ARDGYARYYFDY

SEQ ID NO: 3864 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3865 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccggaaagaactacttagcttggtaccagcagaaaccaggacagcctcctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctcggagaactttcggcggagggaccaaggtcgagatcaaa

SEQ ID NO: 3866 - protein, 112 aa, Artificial Sequence
  Description of Artificial Sequence: Synthetic Light chain variable region amino acid sequence
DIVMTQSPDSLAVSLGERATINCKSSQSLLNSRTGKNYLAWYQQKPGQPPKLLIYWASTRESGVPDRFSGSGSGTDFTLTISSLQAEDVAVYYCKQSYSRRTFGGGTKVEIK

SEQ ID NO: 3867 - protein, 17 aa, Artificial Sequence
  Description of Artificial Sequence: Synthetic Light chain variable region CDR L1 amino acid sequence
KSSQSLLNSRTGKNYLA

SEQ ID NO: 3868 - DNA, 51 bp, Artificial Sequence
  Description of Artificial Sequence: Synthetic Light chain variable region CDR L1 nucleic acid sequence
aagtccagccagagtcttttaaacagcagaaccggaaagaactacttagct

SEQ ID NO: 3869 - protein, 7 aa, Artificial Sequence
  Description of Artificial Sequence: Synthetic Light chain variable region CDR L2 amino acid sequence
WASTRES

SEQ ID NO: 3870 - DNA, 21 bp, Artificial Sequence
  Description of Artificial Sequence: Synthetic Light chain variable region CDR L2 nucleic acid sequence
tgggcatctacccgggaatcc

SEQ ID NO: 3871 - protein, 8 aa, Artificial Sequence
  Description of Artificial Sequence: Synthetic Light chain variable region CDR L3 amino acid sequence
KQSYSRRT

SEQ ID NO: 3872 - DNA, 24 bp, Artificial Sequence
  Description of Artificial Sequence: Synthetic Light chain variable region CDR L3 nucleic acid sequence
aagcaatcttattctcggagaact

SEQ ID NO: 3873 - DNA, 357 bp, Artificial Sequence; identical to SEQ ID NO: 3585
  Description of Artificial Sequence: Synthetic Heavy chain variable region nucleic acid sequence

SEQ ID NO: 3874 - protein, 119 aa, Artificial Sequence; identical to SEQ ID NO: 3586
  Description of Artificial Sequence: Synthetic Heavy chain variable region amino acid sequence

SEQ ID NO: 3875 - protein, 9 aa, Artificial Sequence
  Description of Artificial Sequence: Synthetic Heavy chain variable region CDR H1 amino acid sequence
FNTKDYYMH

SEQ ID NO: 3876 - DNA, 27 bp, Artificial Sequence
  Description of Artificial Sequence: Synthetic Heavy chain variable region CDR H1 nucleic acid sequence
ttcaacaccaaggactactatatgcac

SEQ ID NO: 3877 - protein, 17 aa, Artificial Sequence
  Description of Artificial Sequence: Synthetic Heavy chain variable region CDR H2 amino acid sequence
WIGPENGNTIYDPKFQG

SEQ ID NO: 3878 - DNA, 51 bp, Artificial Sequence; identical to SEQ ID NO: 3590
  Description of Artificial Sequence: Synthetic Heavy chain variable region CDR H2 nucleic acid sequence

SEQ ID NO: 3879 - protein, 12 aa, Artificial Sequence
  Description of Artificial Sequence: Synthetic Heavy chain variable region CDR H3 amino acid sequence
ARDGYARYYFDY

SEQ ID NO: 3880 - DNA, 36 bp, Artificial Sequence; identical to SEQ ID NO: 3592
  Description of Artificial Sequence: Synthetic Heavy chain variable region CDR H3 nucleic acid sequence

SEQ ID NO: 3881 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacaacagaaccagaaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtaagcaatcttattctcggagaactttcggcggagggaccaaggttgagatcaaa

SEQ ID NO: 3882 - protein, 112 aa, Artificial Sequence
  Description of Artificial Sequence: Synthetic Light chain variable region amino acid sequence
DIVMTQSPDSLAVSLGERATINCKSSQSLLNNRTRKNYLAWYQQKPGQPPKLLIYWASTRESGVPDRFSGSGSGTDFTLTISSLQAEDVAVYYCKQSYSRRTFGGGTKVEIK

SEQ ID NO: 3883 - protein, 17 aa, Artificial Sequence
  Description of Artificial Sequence: Synthetic Light chain variable region CDR L1 amino acid sequence
KSSQSLLNNRTRKNYLA

SEQ ID NO: 3884 - DNA, 51 bp, Artificial Sequence
  Description of Artificial Sequence: Synthetic Light chain variable region CDR L1 nucleic acid sequence
aagtccagccagagtcttttaaacaacagaaccagaaagaactacttagct

SEQ ID NO: 3885 - protein, 7 aa, Artificial Sequence
  Description of Artificial Sequence: Synthetic Light chain variable region CDR L2 amino acid sequence
WASTRES

SEQ ID NO: 3886 - DNA, 21 bp, Artificial Sequence
  Description of Artificial Sequence: Synthetic Light chain variable region CDR L2 nucleic acid sequence
tgggcatctacccgggaatcc

SEQ ID NO: 3887 - protein, 8 aa, Artificial Sequence
  Description of Artificial Sequence: Synthetic Light chain variable region CDR L3 amino acid sequence
KQSYSRRT

SEQ ID NO: 3888 - DNA, 24 bp, Artificial Sequence
  Description of Artificial Sequence: Synthetic Light chain variable region CDR L3 nucleic acid sequence
aagcaatcttattctcggagaact

SEQ ID NO: 3889 - DNA, 357 bp, Artificial Sequence; identical to SEQ ID NO: 3649
  Description of Artificial Sequence: Synthetic Heavy chain variable region nucleic acid sequence

SEQ ID NO: 3890 - protein, 119 aa, Artificial Sequence; identical to SEQ ID NO: 3570
  Description of Artificial Sequence: Synthetic Heavy chain variable region amino acid sequence

SEQ ID NO: 3891 - protein, 9 aa, Artificial Sequence
  Description of Artificial Sequence: Synthetic Heavy chain variable region CDR H1 amino acid sequence
FNIKDYYMH

SEQ ID NO: 3892 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3893 - protein, 17 aa, Artificial Sequence
  Description of Artificial Sequence: Synthetic Heavy chain variable region CDR H2 amino acid sequence
WIDLENGNTIYDPKFQG

SEQ ID NO: 3894 - DNA, 51 bp, Artificial Sequence; identical to SEQ ID NO: 3606
  Description of Artificial Sequence: Synthetic Heavy chain variable region CDR H2 nucleic acid sequence

SEQ ID NO: 3895 - protein, 12 aa, Artificial Sequence
  Description of Artificial Sequence: Synthetic Heavy chain variable region CDR H3 amino acid sequence
ARDGYARYYFDY

SEQ ID NO: 3896 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3897 - DNA, 336 bp, Artificial Sequence; identical to SEQ ID NO: 3577
  Description of Artificial Sequence: Synthetic Light chain variable region nucleic acid sequence

SEQ ID NO: 3898 - protein, 112 aa, Artificial Sequence; identical to SEQ ID NO: 3578
  Description of Artificial Sequence: Synthetic Light chain variable region amino acid sequence

SEQ ID NO: 3899 - protein, 17 aa, Artificial Sequence
  Description of Artificial Sequence: Synthetic Light chain variable region CDR L1 amino acid sequence
KSSQSLLNSRTRKNYLA

SEQ ID NO: 3900 - DNA, 51 bp, Artificial Sequence; identical to SEQ ID NO: 2988
  Description of Artificial Sequence: Synthetic Light chain variable region CDR L1 nucleic acid sequence

SEQ ID NO: 3901 - protein, 7 aa, Artificial Sequence
  Description of Artificial Sequence: Synthetic Light chain variable region CDR L2 amino acid sequence
WASTRES

SEQ ID NO: 3902 - DNA, 21 bp, Artificial Sequence
  Description of Artificial Sequence: Synthetic Light chain variable region CDR L2 nucleic acid sequence
tgggcatctacccgggaatcc

SEQ ID NO: 3903 - protein, 8 aa, Artificial Sequence
  Description of Artificial Sequence: Synthetic Light chain variable region CDR L3 amino acid sequence
KQSYFRRA

SEQ ID NO: 3904 - DNA, 24 bp, Artificial Sequence
  Description of Artificial Sequence: Synthetic Light chain variable region CDR L3 nucleic acid sequence
aagcaatcttattttcggagagct

SEQ ID NO: 3905 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtcgcctgcaaggcttctggatccaatatcaaggactactatgtgcactgggtgcgacaggcccctggacaaaggcttgagtggatgggatggatcggccctgaaaatggtaacacagtctatgacccgaagtttcagggcagggtcaccataaccagggacacgtccgccagcacagcctacatggagctgagcagcctgagatctgaagacacggcggtgtactactgcgcgagagatggatacgctagatattactttgactactggggccaaggaaccctggtcaccgtctcctca

SEQ ID NO: 3906 - protein, 119 aa, Artificial Sequence
  Description of Artificial Sequence: Synthetic Heavy chain variable region amino acid sequence
QVQLVQSGAEVKKPGASVKVACKASGSNIKDYYVHWVRQAPGQRLEWMGWIGPENGNTVYDPKFQGRVTITRDTSASTAYMELSSLRSEDTAVYYCARDGYARYYFDYWGQGTLVTVSS

SEQ ID NO: 3907 - protein, 9 aa, Artificial Sequence
  Description of Artificial Sequence: Synthetic Heavy chain variable region CDR H1 amino acid sequence
SNIKDYYVH

SEQ ID NO: 3908 - DNA, 27 bp, Artificial Sequence
  Description of Artificial Sequence: Synthetic Heavy chain variable region CDR H1 nucleic acid sequence
tccaatatcaaggactactatgtgcac

SEQ ID NO: 3909 - protein, 17 aa, Artificial Sequence
  Description of Artificial Sequence: Synthetic Heavy chain variable region CDR H2 amino acid sequence
WIGPENGNTVYDPKFQG

SEQ ID NO: 3910 - DNA, 51 bp, Artificial Sequence
  Description of Artificial Sequence: Synthetic Heavy chain variable region CDR H2 nucleic acid sequence
tggatcggccctgaaaatggtaacacagtctatgacccgaagtttcagggc

SEQ ID NO: 3911 - protein, 12 aa, Artificial Sequence
  Description of Artificial Sequence: Synthetic Heavy chain variable region CDR H3 amino acid sequence
ARDGYARYYFDY

SEQ ID NO: 3912 - DNA, 36 bp, Artificial Sequence; identical to SEQ ID NO: 3416
  Description of Artificial Sequence: Synthetic Heavy chain variable region CDR H3 nucleic acid sequence

SEQ ID NO: 3913 - DNA, 336 bp, Artificial Sequence; identical to SEQ ID NO: 2985
  Description of Artificial Sequence: Synthetic Light chain variable region nucleic acid sequence

SEQ ID NO: 3914 - protein, 112 aa, Artificial Sequence; identical to SEQ ID NO: 2986
  Description of Artificial Sequence: Synthetic Light chain variable region amino acid sequence

SEQ ID NO: 3915 - protein, 17 aa, Artificial Sequence
  Description of Artificial Sequence: Synthetic Light chain variable region CDR L1 amino acid sequence
KSSQSLLNSRTRKNYLA

SEQ ID NO: 3916 - DNA, 51 bp, Artificial Sequence; identical to SEQ ID NO: 2988
  Description of Artificial Sequence: Synthetic Light chain variable region CDR L1 nucleic acid sequence

SEQ ID NO: 3917 - protein, 7 aa, Artificial Sequence
  Description of Artificial Sequence: Synthetic Light chain variable region CDR L2 amino acid sequence
WASTRES

SEQ ID NO: 3918 - DNA, 21 bp, Artificial Sequence
  Description of Artificial Sequence: Synthetic Light chain variable region CDR L2 nucleic acid sequence
tgggcatctacccgggaatcc

SEQ ID NO: 3919 - protein, 8 aa, Artificial Sequence
  Description of Artificial Sequence: Synthetic Light chain variable region CDR L3 amino acid sequence
KQSYSLRT

SEQ ID NO: 3920 - DNA, 24 bp, Artificial Sequence
  Description of Artificial Sequence: Synthetic Light chain variable region CDR L3 nucleic acid sequence
aagcaatcttattctctgagaact

SEQ ID NO: 3921 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagccactatatacactgggtgcgacaggcccctggacaagggcttgagtggatgggatggatctaccctggtgatggtagcacaaagtacaacgagaagttcaagggcagagtcaccatgaccgcggacaagtccacgagcacagcctacatggagctgagcagcctgagatctgaggacacggcggtgtactactgcgctagagatggctcatattactttgactactggggccaaggaaccctggtcaccgtctcctca

SEQ ID NO: 3922 - protein, 117 aa, Artificial Sequence
  Description of Artificial Sequence: Synthetic Heavy chain variable region amino acid sequence
QVQLVQSGAEVKKPGASVKVSCKASGYTFTSHYIHWVRQAPGQGLEWMGWIYPGDGSTKYNEKFKGRVTMTADKSTSTAYMELSSLRSEDTAVYYCARDGSYYFDYWGQGTLVTVSS

SEQ ID NO: 3923 - protein, 9 aa, Artificial Sequence
  Description of Artificial Sequence: Synthetic Heavy chain variable region CDR H1 amino acid sequence
YTFTSHYIH

SEQ ID NO: 3924 - DNA, 27 bp, Artificial Sequence
  Description of Artificial Sequence: Synthetic Heavy chain variable region CDR H1 nucleic acid sequence
tacaccttcaccagccactatatacac

SEQ ID NO: 3925 - protein, 17 aa, Artificial Sequence
  Description of Artificial Sequence: Synthetic Heavy chain variable region CDR H2 amino acid sequence
WIYPGDGSTKYNEKFKG

SEQ ID NO: 3926 - DNA, 51 bp, Artificial Sequence; identical to SEQ ID NO: 2982
  Description of Artificial Sequence: Synthetic Heavy chain variable region CDR H2 nucleic acid sequence

SEQ ID NO: 3927 - protein, 10 aa, Artificial Sequence
  Description of Artificial Sequence: Synthetic Heavy chain variable region CDR H3 amino acid sequence
ARDGSYYFDY

SEQ ID NO: 3928 - DNA, 30 bp, Artificial Sequence; identical to SEQ ID NO: 3032
  Description of Artificial Sequence: Synthetic Heavy chain variable region CDR H3 nucleic acid sequence

SEQ ID NO: 3929 - DNA, 336 bp, Artificial Sequence; identical to SEQ ID NO: 2985
  Description of Artificial Sequence: Synthetic Light chain variable region nucleic acid sequence

SEQ ID NO: 3930 - protein, 112 aa, Artificial Sequence; identical to SEQ ID NO: 2986
  Description of Artificial Sequence: Synthetic Light chain variable region amino acid sequence

SEQ ID NO: 3931 - protein, 17 aa, Artificial Sequence
  Description of Artificial Sequence: Synthetic Light chain variable region CDR L1 amino acid sequence
KSSQSLLNSRTRKNYLA

SEQ ID NO: 3932 - DNA, 51 bp, Artificial Sequence; identical to SEQ ID NO: 2988
  Description of Artificial Sequence: Synthetic Light chain variable region CDR L1 nucleic acid sequence

SEQ ID NO: 3933 - protein, 7 aa, Artificial Sequence
  Description of Artificial Sequence: Synthetic Light chain variable region CDR L2 amino acid sequence
WASTRES

SEQ ID NO: 3934 - DNA, 21 bp, Artificial Sequence
  Description of Artificial Sequence: Synthetic Light chain variable region CDR L2 nucleic acid sequence
tgggcatctacccgggaatcc

SEQ ID NO: 3935 - protein, 8 aa, Artificial Sequence
  Description of Artificial Sequence: Synthetic Light chain variable region CDR L3 amino acid sequence
KQSYSLRT

SEQ ID NO: 3936 - DNA, 24 bp, Artificial Sequence
  Description of Artificial Sequence: Synthetic Light chain variable region CDR L3 nucleic acid sequence
aagcaatcttattctctgagaact

SEQ ID NO: 3937 - DNA, 351 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtttcctgcaaggcatctggatacaccttcaccagctcctatatacactgggtgcgacaggcccctggacaagggcttgagtggataggatggatctaccctggtaatgttgacacaaggtacaacgagaagttcaagggcagagtcaccataaccgcggacaagtccgcgagcacagcctacatggagctgagcagcctgagatctgaggacacggcggtgtactactgcgcgagggattacggatactactttgactactggggccaaggaaccctggtcaccgtctcctca

SEQ ID NO: 3938 - protein, 117 aa, Artificial Sequence
  Description of Artificial Sequence: Synthetic Heavy chain variable region amino acid sequence
QVQLVQSGAEVKKPGASVKVSCKASGYTFTSSYIHWVRQAPGQGLEWIGWIYPGNVDTRYNEKFKGRVTITADKSASTAYMELSSLRSEDTAVYYCARDYGYYFDYWGQGTLVTVSS

SEQ ID NO: 3939 - protein, 9 aa, Artificial Sequence
  Description of Artificial Sequence: Synthetic Heavy chain variable region CDR H1 amino acid sequence
YTFTSSYIH

SEQ ID NO: 3940 - DNA, 27 bp, Artificial Sequence
  Description of Artificial Sequence: Synthetic Heavy chain variable region CDR H1 nucleic acid sequence
tacaccttcaccagctcctatatacac

SEQ ID NO: 3941 - protein, 17 aa, Artificial Sequence
  Description of Artificial Sequence: Synthetic Heavy chain variable region CDR H2 amino acid sequence
WIYPGNVDTRYNEKFKG

SEQ ID NO: 3942 - DNA, 51 bp, Artificial Sequence
  Description of Artificial Sequence: Synthetic Heavy chain variable region CDR H2 nucleic acid sequence
tggatctaccctggtaatgttgacacaaggtacaacgagaagttcaagggc

SEQ ID NO: 3943 - protein, 10 aa, Artificial Sequence
  Description of Artificial Sequence: Synthetic Heavy chain variable region CDR H3 amino acid sequence
ARDYGYYFDY

SEQ ID NO: 3944 - DNA, 30 bp, Artificial Sequence; identical to SEQ ID NO: 3208
  Description of Artificial Sequence: Synthetic Heavy chain variable region CDR H3 nucleic acid sequence

SEQ ID NO: 3945 - DNA, 336 bp, Artificial Sequence; identical to SEQ ID NO: 2985
  Description of Artificial Sequence: Synthetic Light chain variable region nucleic acid sequence

SEQ ID NO: 3946 - protein, 112 aa, Artificial Sequence; identical to SEQ ID NO: 2986
  Description of Artificial Sequence: Synthetic Light chain variable region amino acid sequence

SEQ ID NO: 3947 - protein, 17 aa, Artificial Sequence
  Description of Artificial Sequence: Synthetic Light chain variable region CDR L1 amino acid sequence
KSSQSLLNSRTRKNYLA

SEQ ID NO: 3948 - DNA, 51 bp, Artificial Sequence; identical to SEQ ID NO: 2988
  Description of Artificial Sequence: Synthetic Light chain variable region CDR L1 nucleic acid sequence

SEQ ID NO: 3949 - protein, 7 aa, Artificial Sequence
  Description of Artificial Sequence: Synthetic Light chain variable region CDR L2 amino acid sequence
WASTRES

SEQ ID NO: 3950 - DNA, 21 bp, Artificial Sequence
  Description of Artificial Sequence: Synthetic Light chain variable region CDR L2 nucleic acid sequence
tgggcatctacccgggaatcc

SEQ ID NO: 3951 - protein, 8 aa, Artificial Sequence
  Description of Artificial Sequence: Synthetic Light chain variable region CDR L3 amino acid sequence
KQSYSLRT

SEQ ID NO: 3952 - DNA, 24 bp, Artificial Sequence
  Description of Artificial Sequence: Synthetic Light chain variable region CDR L3 nucleic acid sequence
aagcaatcttattctctgagaact

SEQ ID NO: 3953 - DNA, 357 bp, Artificial Sequence; identical to SEQ ID NO: 3425
  Description of Artificial Sequence: Synthetic Heavy chain variable region nucleic acid sequence

SEQ ID NO: 3954 - protein, 119 aa, Artificial Sequence; identical to SEQ ID NO: 3426
  Description of Artificial Sequence: Synthetic Heavy chain variable region amino acid sequence

SEQ ID NO: 3955 - protein, 9 aa, Artificial Sequence
  Description of Artificial Sequence: Synthetic Heavy chain variable region CDR H1 amino acid sequence
FNIKDYYMH

SEQ ID NO: 3956 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3957 - protein, 17 aa, Artificial Sequence
  Description of Artificial Sequence: Synthetic Heavy chain variable region CDR H2 amino acid sequence
WIDPENGNTIYDPKFQG

SEQ ID NO: 3958 - DNA, 51 bp, Artificial Sequence; identical to SEQ ID NO: 3414
  Description of Artificial Sequence: Synthetic Heavy chain variable region CDR H2 nucleic acid sequence

SEQ ID NO: 3959 - protein, 12 aa, Artificial Sequence
  Description of Artificial Sequence: Synthetic Heavy chain variable region CDR H3 amino acid sequence
ARDGYARYYFDY

SEQ ID NO: 3960 - DNA, 36 bp, Artificial Sequence; identical to SEQ ID NO: 3432
  Description of Artificial Sequence: Synthetic Heavy chain variable region CDR H3 nucleic acid sequence

SEQ ID NO: 3961 - DNA, 336 bp, Artificial Sequence; identical to SEQ ID NO: 2985
  Description of Artificial Sequence: Synthetic Light chain variable region nucleic acid sequence

SEQ ID NO: 3962 - protein, 112 aa, Artificial Sequence; identical to SEQ ID NO: 2986
  Description of Artificial Sequence: Synthetic Light chain variable region amino acid sequence

SEQ ID NO: 3963 - protein, 17 aa, Artificial Sequence
  Description of Artificial Sequence: Synthetic Light chain variable region CDR L1 amino acid sequence
KSSQSLLNSRTRKNYLA

SEQ ID NO: 3964 - DNA, 51 bp, Artificial Sequence; identical to SEQ ID NO: 2988
  Description of Artificial Sequence: Synthetic Light chain variable region CDR L1 nucleic acid sequence

SEQ ID NO: 3965 - protein, 7 aa, Artificial Sequence
  Description of Artificial Sequence: Synthetic Light chain variable region CDR L2 amino acid sequence
WASTRES

SEQ ID NO: 3966 - DNA, 21 bp, Artificial Sequence
  Description of Artificial Sequence: Synthetic Light chain variable region CDR L2 nucleic acid sequence
tgggcatctacccgggaatcc

SEQ ID NO: 3967 - protein, 8 aa, Artificial Sequence
  Description of Artificial Sequence: Synthetic Light chain variable region CDR L3 amino acid sequence
KQSYSLRT

SEQ ID NO: 3968 - DNA, 24 bp, Artificial Sequence
  Description of Artificial Sequence: Synthetic Light chain variable region CDR L3 nucleic acid sequence
aagcaatcttattctctgagaact

SEQ ID NO: 3969 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatattactttgactactggggccaaggaaccctggtcaccgtctcctca

SEQ ID NO: 3970 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYGRYYFDYWGQGTLVTVSS

SEQ ID NO: 3971 - protein, 9 aa, Artificial Sequence
  Description of Artificial Sequence: Synthetic Heavy chain variable region CDR H1 amino acid sequence
FNIKDYYMH

SEQ ID NO: 3972 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3973 - protein, 17 aa, Artificial Sequence
  Description of Artificial Sequence: Synthetic Heavy chain variable region CDR H2 amino acid sequence
WIDLENGNTIYDPKFQG

SEQ ID NO: 3974 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 3975 - protein, 12 aa, Artificial Sequence
  Description of Artificial Sequence: Synthetic Heavy chain variable region CDR H3 amino acid sequence
ARDGYGRYYFDY

SEQ ID NO: 3976 - DNA, 36 bp, Artificial Sequence
  Description of Artificial Sequence: Synthetic Heavy chain variable region CDR H3 nucleic acid sequence
gcgagagatggatacgggagatattactttgactac

SEQ ID NO: 3977 - DNA, 336 bp, Artificial Sequence; identical to SEQ ID NO: 3865
  Description of Artificial Sequence: Synthetic Light chain variable region nucleic acid sequence

SEQ ID NO: 3978 - protein, 112 aa, Artificial Sequence; identical to SEQ ID NO: 3866
  Description of Artificial Sequence: Synthetic Light chain variable region amino acid sequence

SEQ ID NO: 3979 - protein, 17 aa, Artificial Sequence
  Description of Artificial Sequence: Synthetic Light chain variable region CDR L1 amino acid sequence
KSSQSLLNSRTGKNYLA

SEQ ID NO: 3980 - DNA, 51 bp, Artificial Sequence; identical to SEQ ID NO: 3868
  Description of Artificial Sequence: Synthetic Light chain variable region CDR L1 nucleic acid sequence

SEQ ID NO: 3981 - protein, 7 aa, Artificial Sequence
  Description of Artificial Sequence: Synthetic Light chain variable region CDR L2 amino acid sequence
WASTRES

SEQ ID NO: 3982 - DNA, 21 bp, Artificial Sequence
  Description of Artificial Sequence: Synthetic Light chain variable region CDR L2 nucleic acid sequence
tgggcatctacccgggaatcc

SEQ ID NO: 3983 - protein, 8 aa, Artificial Sequence
  Description of Artificial Sequence: Synthetic Light chain variable region CDR L3 amino acid sequence
KQSYSRRT

SEQ ID NO: 3984 - DNA, 24 bp, Artificial Sequence
  Description of Artificial Sequence: Synthetic Light chain variable region CDR L3 nucleic acid sequence
aagcaatcttattctcggagaact

SEQ ID NO: 3985 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatattactttgacatttggggccaaggaaccctggtcaccgtctcctca

SEQ ID NO: 3986 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYARYYFDIWGQGTLVTVSS

SEQ ID NO: 3987 - protein, 9 aa, Artificial Sequence
  Description of Artificial Sequence: Synthetic Heavy chain variable region CDR H1 amino acid sequence
FNIKDYYMH

SEQ ID NO: 3988 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 3989 - protein, 17 aa, Artificial Sequence
  Description of Artificial Sequence: Synthetic Heavy chain variable region CDR H2 amino acid sequence
WIDLENGNTIYDPKFQG

SEQ ID NO: 3990 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 3991 - protein, 12 aa, Artificial Sequence
  Description of Artificial Sequence: Synthetic Heavy chain variable region CDR H3 amino acid sequence
ARDGYARYYFDI

SEQ ID NO: 3992 - DNA, 36 bp, Artificial Sequence
  Description of Artificial Sequence: Synthetic Heavy chain variable region CDR H3 nucleic acid sequence
gcgagagatggatacgctagatattactttgacatt

SEQ ID NO: 3993 - DNA, 336 bp, Artificial Sequence; identical to SEQ ID NO: 3865
  Description of Artificial Sequence: Synthetic Light chain variable region nucleic acid sequence

SEQ ID NO: 3994 - protein, 112 aa, Artificial Sequence; identical to SEQ ID NO: 3866
  Description of Artificial Sequence: Synthetic Light chain variable region amino acid sequence

SEQ ID NO: 3995 - protein, 17 aa, Artificial Sequence
  Description of Artificial Sequence: Synthetic Light chain variable region CDR L1 amino acid sequence
KSSQSLLNSRTGKNYLA

SEQ ID NO: 3996 - DNA, 51 bp, Artificial Sequence; identical to SEQ ID NO: 3868
  Description of Artificial Sequence: Synthetic Light chain variable region CDR L1 nucleic acid sequence

SEQ ID NO: 3997 - protein, 7 aa, Artificial Sequence
  Description of Artificial Sequence: Synthetic Light chain variable region CDR L2 amino acid sequence
WASTRES

SEQ ID NO: 3998 - DNA, 21 bp, Artificial Sequence
  Description of Artificial Sequence: Synthetic Light chain variable region CDR L2 nucleic acid sequence
tgggcatctacccgggaatcc

SEQ ID NO: 3999 - protein, 8 aa, Artificial Sequence
  Description of Artificial Sequence: Synthetic Light chain variable region CDR L3 amino acid sequence
KQSYSRRT

SEQ ID NO: 4000 - DNA, 24 bp, Artificial Sequence
  Description of Artificial Sequence: Synthetic Light chain variable region CDR L3 nucleic acid sequence
aagcaatcttattctcggagaact

SEQ ID NO: 4001 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatattactttgacgcttggggccaaggaaccctggtcaccgtctcctca

SEQ ID NO: 4002 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYGRYYFDAWGQGTLVTVSS

SEQ ID NO: 4003 - protein, 9 aa, Artificial Sequence
  Description of Artificial Sequence: Synthetic Heavy chain variable region CDR H1 amino acid sequence
FNIKDYYMH

SEQ ID NO: 4004 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4005 - protein, 17 aa, Artificial Sequence
  Description of Artificial Sequence: Synthetic Heavy chain variable region CDR H2 amino acid sequence
WIDLENGNTIYDPKFQG

SEQ ID NO: 4006 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4007 - protein, 12 aa, Artificial Sequence
  Description of Artificial Sequence: Synthetic Heavy chain variable region CDR H3 amino acid sequence
ARDGYGRYYFDA

SEQ ID NO: 4008 - DNA, 36 bp, Artificial Sequence
  Description of Artificial Sequence: Synthetic Heavy chain variable region CDR H3 nucleic acid sequence
gcgagagatggatacgggagatattactttgacgct

SEQ ID NO: 4009 - DNA, 336 bp, Artificial Sequence; identical to SEQ ID NO: 3865
  Description of Artificial Sequence: Synthetic Light chain variable region nucleic acid sequence

SEQ ID NO: 4010 - protein, 112 aa, Artificial Sequence; identical to SEQ ID NO: 3866
  Description of Artificial Sequence: Synthetic Light chain variable region amino acid sequence

SEQ ID NO: 4011 - protein, 17 aa, Artificial Sequence
  Description of Artificial Sequence: Synthetic Light chain variable region CDR L1 amino acid sequence
KSSQSLLNSRTGKNYLA

SEQ ID NO: 4012 - DNA, 51 bp, Artificial Sequence; identical to SEQ ID NO: 3868
  Description of Artificial Sequence: Synthetic Light chain variable region CDR L1 nucleic acid sequence

SEQ ID NO: 4013 - protein, 7 aa, Artificial Sequence
  Description of Artificial Sequence: Synthetic Light chain variable region CDR L2 amino acid sequence
WASTRES

SEQ ID NO: 4014 - DNA, 21 bp, Artificial Sequence
  Description of Artificial Sequence: Synthetic Light chain variable region CDR L2 nucleic acid sequence
tgggcatctacccgggaatcc

SEQ ID NO: 4015 - protein, 8 aa, Artificial Sequence
  Description of Artificial Sequence: Synthetic Light chain variable region CDR L3 amino acid sequence
KQSYSRRT

SEQ ID NO: 4016 - DNA, 24 bp, Artificial Sequence
  Description of Artificial Sequence: Synthetic Light chain variable region CDR L3 nucleic acid sequence
aagcaatcttattctcggagaact

SEQ ID NO: 4017 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatatttttttgactactggggccaaggaaccctggtcaccgtctcctca

SEQ ID NO: 4018 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYARYFFDYWGQGTLVTVSS

SEQ ID NO: 4019 - protein, 9 aa, Artificial Sequence
  Description of Artificial Sequence: Synthetic Heavy chain variable region CDR H1 amino acid sequence
FNIKDYYMH

SEQ ID NO: 4020 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4021 - protein, 17 aa, Artificial Sequence
  Description of Artificial Sequence: Synthetic Heavy chain variable region CDR H2 amino acid sequence
WIDLENGNTIYDPKFQG

SEQ ID NO: 4022 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4023 - protein, 12 aa, Artificial Sequence
  Description of Artificial Sequence: Synthetic Heavy chain variable region CDR H3 amino acid sequence
ARDGYARYFFDY

SEQ ID NO: 4024 - DNA, 36 bp, Artificial Sequence
  Description of Artificial Sequence: Synthetic Heavy chain variable region CDR H3 nucleic acid sequence
gcgagagatggatacgctagatatttttttgactac

SEQ ID NO: 4025 - DNA, 336 bp, Artificial Sequence; identical to SEQ ID NO: 3865
  Description of Artificial Sequence: Synthetic Light chain variable region nucleic acid sequence

SEQ ID NO: 4026 - protein, 112 aa, Artificial Sequence; identical to SEQ ID NO: 3866
  Description of Artificial Sequence: Synthetic Light chain variable region amino acid sequence

SEQ ID NO: 4027 - protein, 17 aa, Artificial Sequence
  Description of Artificial Sequence: Synthetic Light chain variable region CDR L1 amino acid sequence
KSSQSLLNSRTGKNYLA

SEQ ID NO: 4028 - DNA, 51 bp, Artificial Sequence; identical to SEQ ID NO: 3868
  Description of Artificial Sequence: Synthetic Light chain variable region CDR L1 nucleic acid sequence

SEQ ID NO: 4029 - protein, 7 aa, Artificial Sequence
  Description of Artificial Sequence: Synthetic Light chain variable region CDR L2 amino acid sequence
WASTRES

SEQ ID NO: 4030 - DNA, 21 bp, Artificial Sequence
  Description of Artificial Sequence: Synthetic Light chain variable region CDR L2 nucleic acid sequence
tgggcatctacccgggaatcc

SEQ ID NO: 4031 - protein, 8 aa, Artificial Sequence
  Description of Artificial Sequence: Synthetic Light chain variable region CDR L3 amino acid sequence
KQSYSRRT

SEQ ID NO: 4032 - DNA, 24 bp, Artificial Sequence
  Description of Artificial Sequence: Synthetic Light chain variable region CDR L3 nucleic acid sequence
aagcaatcttattctcggagaact

SEQ ID NO: 4033 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatatttttttgactactggggccaaggaaccctggtcaccgtctcctca

SEQ ID NO: 4034 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYGRYFFDYWGQGTLVTVSS

SEQ ID NO: 4035 - protein, 9 aa, Artificial Sequence
  Description of Artificial Sequence: Synthetic Heavy chain variable region CDR H1 amino acid sequence
FNIKDYYMH

SEQ ID NO: 4036 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4037 - protein, 17 aa, Artificial Sequence
  Description of Artificial Sequence: Synthetic Heavy chain variable region CDR H2 amino acid sequence
WIDLENGNTIYDPKFQG

SEQ ID NO: 4038 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4039 - protein, 12 aa, Artificial Sequence
  Description of Artificial Sequence: Synthetic Heavy chain variable region CDR H3 amino acid sequence
ARDGYGRYFFDY

SEQ ID NO: 4040 - DNA, 36 bp, Artificial Sequence
  Description of Artificial Sequence: Synthetic Heavy chain variable region CDR H3 nucleic acid sequence
gcgagagatggatacgggagatatttttttgactac

SEQ ID NO: 4041 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccggaaagaactacttggcttggtaccagcagaaaccaggacagcctcctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctcggagaactttcggcggagggaccaaggtcgagatcaaa

SEQ ID NO: 4042 - protein, 112 aa, Artificial Sequence; identical to SEQ ID NO: 3866
  Description of Artificial Sequence: Synthetic Light chain variable region amino acid sequence

SEQ ID NO: 4043 - protein, 17 aa, Artificial Sequence
  Description of Artificial Sequence: Synthetic Light chain variable region CDR L1 amino acid sequence
KSSQSLLNSRTGKNYLA

SEQ ID NO: 4044 - DNA, 51 bp, Artificial Sequence
  Description of Artificial Sequence: Synthetic Light chain variable region CDR L1 nucleic acid sequence
aagtccagccagagtcttttaaacagcagaaccggaaagaactacttggct

SEQ ID NO: 4045 - protein, 7 aa, Artificial Sequence
  Description of Artificial Sequence: Synthetic Light chain variable region CDR L2 amino acid sequence
WASTRES

SEQ ID NO: 4046 - DNA, 21 bp, Artificial Sequence
  Description of Artificial Sequence: Synthetic Light chain variable region CDR L2 nucleic acid sequence
tgggcatctacccgggaatcc

SEQ ID NO: 4047 - protein, 8 aa, Artificial Sequence
  Description of Artificial Sequence: Synthetic Light chain variable region CDR L3 amino acid sequence
KQSYSRRT

SEQ ID NO: 4048 - DNA, 24 bp, Artificial Sequence
  Description of Artificial Sequence: Synthetic Light chain variable region CDR L3 nucleic acid sequence
aagcaatcttattctcggagaact

SEQ ID NO: 4049 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatattactacgactactggggccaaggaaccctggtcaccgtctcctca

SEQ ID NO: 4050 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYGRYYYDYWGQGTLVTVSS

SEQ ID NO: 4051 - protein, 9 aa, Artificial Sequence
  Description of Artificial Sequence: Synthetic Heavy chain variable region CDR H1 amino acid sequence
FNIKDYYMH

SEQ ID NO: 4052 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4053 - protein, 17 aa, Artificial Sequence
  Description of Artificial Sequence: Synthetic Heavy chain variable region CDR H2 amino acid sequence
WIDLENGNTIYDPKFQG

SEQ ID NO: 4054 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4055 - protein, 12 aa, Artificial Sequence
  Description of Artificial Sequence: Synthetic Heavy chain variable region CDR H3 amino acid sequence
ARDGYGRYYYDY

SEQ ID NO: 4056 - DNA, 36 bp, Artificial Sequence
  Description of Artificial Sequence: Synthetic Heavy chain variable region CDR H3 nucleic acid sequence
gcgagagatggatacgggagatattactacgactac

SEQ ID NO: 4057 - DNA, 336 bp, Artificial Sequence; identical to SEQ ID NO: 3865
  Description of Artificial Sequence: Synthetic Light chain variable region nucleic acid sequence

SEQ ID NO: 4058 - protein, 112 aa, Artificial Sequence; identical to SEQ ID NO: 3866
  Description of Artificial Sequence: Synthetic Light chain variable region amino acid sequence

SEQ ID NO: 4059 - protein, 17 aa, Artificial Sequence
  Description of Artificial Sequence: Synthetic Light chain variable region CDR L1 amino acid sequence
KSSQSLLNSRTGKNYLA

SEQ ID NO: 4060 - DNA, 51 bp, Artificial Sequence; identical to SEQ ID NO: 3868
  Description of Artificial Sequence: Synthetic Light chain variable region CDR L1 nucleic acid sequence

SEQ ID NO: 4061 - protein, 7 aa, Artificial Sequence
  Description of Artificial Sequence: Synthetic Light chain variable region CDR L2 amino acid sequence
WASTRES

SEQ ID NO: 4062 - DNA, 21 bp, Artificial Sequence
  Description of Artificial Sequence: Synthetic Light chain variable region CDR L2 nucleic acid sequence
tgggcatctacccgggaatcc

SEQ ID NO: 4063 - protein, 8 aa, Artificial Sequence
  Description of Artificial Sequence: Synthetic Light chain variable region CDR L3 amino acid sequence
KQSYSRRT

SEQ ID NO: 4064 - DNA, 24 bp, Artificial Sequence
  Description of Artificial Sequence: Synthetic Light chain variable region CDR L3 nucleic acid sequence
aagcaatcttattctcggagaact

SEQ ID NO: 4065 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatattactacgacgtgtggggccaaggaaccctggtcaccgtctcctca

SEQ ID NO: 4066 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYGRYYYDVWGQGTLVTVSS

SEQ ID NO: 4067 - protein, 9 aa, Artificial Sequence
  Description of Artificial Sequence: Synthetic Heavy chain variable region CDR H1 amino acid sequence
FNIKDYYMH

SEQ ID NO: 4068 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4069 - protein, 17 aa, Artificial Sequence
  Description of Artificial Sequence: Synthetic Heavy chain variable region CDR H2 amino acid sequence
WIDLENGNTIYDPKFQG

SEQ ID NO: 4070 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4071 - protein, 12 aa, Artificial Sequence
  Description of Artificial Sequence: Synthetic Heavy chain variable region CDR H3 amino acid sequence
ARDGYGRYYYDV

SEQ ID NO: 4072 - DNA, 36 bp, Artificial Sequence
  Description of Artificial Sequence: Synthetic Heavy chain variable region CDR H3 nucleic acid sequence
gcgagagatggatacgggagatattactacgacgtg

SEQ ID NO: 4073 - DNA, 336 bp, Artificial Sequence; identical to SEQ ID NO: 3865
  Description of Artificial Sequence: Synthetic Light chain variable region nucleic acid sequence

SEQ ID NO: 4074 - protein, 112 aa, Artificial Sequence; identical to SEQ ID NO: 3866
  Description of Artificial Sequence: Synthetic Light chain variable region amino acid sequence

SEQ ID NO: 4075 - protein, 17 aa, Artificial Sequence
  Description of Artificial Sequence: Synthetic Light chain variable region CDR L1 amino acid sequence
KSSQSLLNSRTGKNYLA

SEQ ID NO: 4076 - DNA, 51 bp, Artificial Sequence; identical to SEQ ID NO: 3868
  Description of Artificial Sequence: Synthetic Light chain variable region CDR L1 nucleic acid sequence

SEQ ID NO: 4077 - protein, 7 aa, Artificial Sequence
  Description of Artificial Sequence: Synthetic Light chain variable region CDR L2 amino acid sequence
WASTRES

SEQ ID NO: 4078 - DNA, 21 bp, Artificial Sequence
  Description of Artificial Sequence: Synthetic Light chain variable region CDR L2 nucleic acid sequence
tgggcatctacccgggaatcc

SEQ ID NO: 4079 - protein, 8 aa, Artificial Sequence
  Description of Artificial Sequence: Synthetic Light chain variable region CDR L3 amino acid sequence
KQSYSRRT

SEQ ID NO: 4080 - DNA, 24 bp, Artificial Sequence
  Description of Artificial Sequence: Synthetic Light chain variable region CDR L3 nucleic acid sequence
aagcaatcttattctcggagaact

SEQ ID NO: 4081 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatatttttacgactactggggccaaggaaccctggtcaccgtctcctca

SEQ ID NO: 4082 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYGRYFYDYWGQGTLVTVSS

SEQ ID NO: 4083 - protein, 9 aa, Artificial Sequence
  Description of Artificial Sequence: Synthetic Heavy chain variable region CDR H1 amino acid sequence
FNIKDYYMH

SEQ ID NO: 4084 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4085 - protein, 17 aa, Artificial Sequence
  Description of Artificial Sequence: Synthetic Heavy chain variable region CDR H2 amino acid sequence
WIDLENGNTIYDPKFQG

SEQ ID NO: 4086 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4087 - protein, 12 aa, Artificial Sequence
  Description of Artificial Sequence: Synthetic Heavy chain variable region CDR H3 amino acid sequence
ARDGYGRYFYDY

SEQ ID NO: 4088 - DNA, 36 bp, Artificial Sequence
  Description of Artificial Sequence: Synthetic Heavy chain variable region CDR H3 nucleic acid sequence
gcgagagatggatacgggagatatttttacgactac

SEQ ID NO: 4089 - DNA, 336 bp, Artificial Sequence; identical to SEQ ID NO: 3865
  Description of Artificial Sequence: Synthetic Light chain variable region nucleic acid sequence

SEQ ID NO: 4090 - protein, 112 aa, Artificial Sequence; identical to SEQ ID NO: 3866
  Description of Artificial Sequence: Synthetic Light chain variable region amino acid sequence

SEQ ID NO: 4091 - protein, 17 aa, Artificial Sequence
  Description of Artificial Sequence: Synthetic Light chain variable region CDR L1 amino acid sequence
KSSQSLLNSRTGKNYLA

SEQ ID NO: 4092 - DNA, 51 bp, Artificial Sequence; identical to SEQ ID NO: 3868
  Description of Artificial Sequence: Synthetic Light chain variable region CDR L1 nucleic acid sequence

SEQ ID NO: 4093 - protein, 7 aa, Artificial Sequence
  Description of Artificial Sequence: Synthetic Light chain variable region CDR L2 amino acid sequence
WASTRES

SEQ ID NO: 4094 - DNA, 21 bp, Artificial Sequence
  Description of Artificial Sequence: Synthetic Light chain variable region CDR L2 nucleic acid sequence
tgggcatctacccgggaatcc

SEQ ID NO: 4095 - protein, 8 aa, Artificial Sequence
  Description of Artificial Sequence: Synthetic Light chain variable region CDR L3 amino acid sequence
KQSYSRRT

SEQ ID NO: 4096 - DNA, 24 bp, Artificial Sequence
  Description of Artificial Sequence: Synthetic Light chain variable region CDR L3 nucleic acid sequence
aagcaatcttattctcggagaact

SEQ ID NO: 4097 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatatttttttgacgtgtggggccaaggaaccctggtcaccgtctcctca

SEQ ID NO: 4098 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYGRYFFDVWGQGTLVTVSS

SEQ ID NO: 4099 - protein, 9 aa, Artificial Sequence
  Description of Artificial Sequence: Synthetic Heavy chain variable region CDR H1 amino acid sequence
FNIKDYYMH

SEQ ID NO: 4100 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4101 - protein, 17 aa, Artificial Sequence
  Description of Artificial Sequence: Synthetic Heavy chain variable region CDR H2 amino acid sequence
WIDLENGNTIYDPKFQG

SEQ ID NO: 4102 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4103 - protein, 12 aa, Artificial Sequence
  Description of Artificial Sequence: Synthetic Heavy chain variable region CDR H3 amino acid sequence
ARDGYGRYFFDV

SEQ ID NO: 4104 - DNA, 36 bp, Artificial Sequence
  Description of Artificial Sequence: Synthetic Heavy chain variable region CDR H3 nucleic acid sequence
gcgagagatggatacgggagatatttttttgacgtg

SEQ ID NO: 4105 - DNA, 336 bp, Artificial Sequence; identical to SEQ ID NO: 3865
  Description of Artificial Sequence: Synthetic Light chain variable region nucleic acid sequence

SEQ ID NO: 4106 - protein, 112 aa, Artificial Sequence; identical to SEQ ID NO: 3866
  Description of Artificial Sequence: Synthetic Light chain variable region amino acid sequence

SEQ ID NO: 4107 - protein, 17 aa, Artificial Sequence
  Description of Artificial Sequence: Synthetic Light chain variable region CDR L1 amino acid sequence
KSSQSLLNSRTGKNYLA

SEQ ID NO: 4108 - DNA, 51 bp, Artificial Sequence; identical to SEQ ID NO: 3868
  Description of Artificial Sequence: Synthetic Light chain variable region CDR L1 nucleic acid sequence

SEQ ID NO: 4109 - protein, 7 aa, Artificial Sequence
  Description of Artificial Sequence: Synthetic Light chain variable region CDR L2 amino acid sequence
WASTRES

SEQ ID NO: 4110 - DNA, 21 bp, Artificial Sequence
  Description of Artificial Sequence: Synthetic Light chain variable region CDR L2 nucleic acid sequence
tgggcatctacccgggaatcc

SEQ ID NO: 4111 - protein, 8 aa, Artificial Sequence
  Description of Artificial Sequence: Synthetic Light chain variable region CDR L3 amino acid sequence
KQSYSRRT

SEQ ID NO: 4112 - DNA, 24 bp, Artificial Sequence
  Description of Artificial Sequence: Synthetic Light chain variable region CDR L3 nucleic acid sequence
aagcaatcttattctcggagaact

SEQ ID NO: 4113 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatatttttttgacatatggggccaaggaaccctggtcaccgtctcctca

SEQ ID NO: 4114 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYARYFFDIWGQGTLVTVSS

SEQ ID NO: 4115 - protein, 9 aa, Artificial Sequence
  Description of Artificial Sequence: Synthetic Heavy chain variable region CDR H1 amino acid sequence
FNIKDYYMH

SEQ ID NO: 4116 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4117 - protein, 17 aa, Artificial Sequence
  Description of Artificial Sequence: Synthetic Heavy chain variable region CDR H2 amino acid sequence
WIDLENGNTIYDPKFQG

SEQ ID NO: 4118 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4119 - protein, 12 aa, Artificial Sequence
  Description of Artificial Sequence: Synthetic Heavy chain variable region CDR H3 amino acid sequence
ARDGYARYFFDI

SEQ ID NO: 4120 - DNA, 36 bp, Artificial Sequence
  Description of Artificial Sequence: Synthetic Heavy chain variable region CDR H3 nucleic acid sequence
gcgagagatggatacgctagatatttttttgacata

SEQ ID NO: 4121 - DNA, 336 bp, Artificial Sequence; identical to SEQ ID NO: 3865
  Description of Artificial Sequence: Synthetic Light chain variable region nucleic acid sequence

SEQ ID NO: 4122 - protein, 112 aa, Artificial Sequence; identical to SEQ ID NO: 3866
  Description of Artificial Sequence: Synthetic Light chain variable region amino acid sequence

SEQ ID NO: 4123 - protein, 17 aa, Artificial Sequence
  Description of Artificial Sequence: Synthetic Light chain variable region CDR L1 amino acid sequence
KSSQSLLNSRTGKNYLA

SEQ ID NO: 4124 - DNA, 51 bp, Artificial Sequence; identical to SEQ ID NO: 3868
  Description of Artificial Sequence: Synthetic Light chain variable region CDR L1 nucleic acid sequence

SEQ ID NO: 4125 - protein, 7 aa, Artificial Sequence
  Description of Artificial Sequence: Synthetic Light chain variable region CDR L2 amino acid sequence
WASTRES

SEQ ID NO: 4126 - DNA, 21 bp, Artificial Sequence
  Description of Artificial Sequence: Synthetic Light chain variable region CDR L2 nucleic acid sequence
tgggcatctacccgggaatcc

SEQ ID NO: 4127 - protein, 8 aa, Artificial Sequence
  Description of Artificial Sequence: Synthetic Light chain variable region CDR L3 amino acid sequence
KQSYSRRT

SEQ ID NO: 4128 - DNA, 24 bp, Artificial Sequence
  Description of Artificial Sequence: Synthetic Light chain variable region CDR L3 nucleic acid sequence
aagcaatcttattctcggagaact

SEQ ID NO: 4129 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatatttttttgacgtgtggggccaaggaaccctggtcaccgtctcctca

SEQ ID NO: 4130 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYARYFFDVWGQGTLVTVSS

SEQ ID NO: 4131 - protein, 9 aa, Artificial Sequence
  Description of Artificial Sequence: Synthetic Heavy chain variable region CDR H1 amino acid sequence
FNIKDYYMH

SEQ ID NO: 4132 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4133 - protein, 17 aa, Artificial Sequence
  Description of Artificial Sequence: Synthetic Heavy chain variable region CDR H2 amino acid sequence
WIDLENGNTIYDPKFQG

SEQ ID NO: 4134 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4135 - protein, 12 aa, Artificial Sequence
  Description of Artificial Sequence: Synthetic Heavy chain variable region CDR H3 amino acid sequence
ARDGYARYFFDV

SEQ ID NO: 4136 - DNA, 36 bp, Artificial Sequence
  Description of Artificial Sequence: Synthetic Heavy chain variable region CDR H3 nucleic acid sequence
gcgagagatggatacgctagatatttttttgacgtg

SEQ ID NO: 4137 - DNA, 336 bp, Artificial Sequence; identical to SEQ ID NO: 3865
  Description of Artificial Sequence: Synthetic Light chain variable region nucleic acid sequence

SEQ ID NO: 4138 - protein, 112 aa, Artificial Sequence; identical to SEQ ID NO: 3866
  Description of Artificial Sequence: Synthetic Light chain variable region amino acid sequence

SEQ ID NO: 4139 - protein, 17 aa, Artificial Sequence
  Description of Artificial Sequence: Synthetic Light chain variable region CDR L1 amino acid sequence
KSSQSLLNSRTGKNYLA

SEQ ID NO: 4140 - DNA, 51 bp, Artificial Sequence; identical to SEQ ID NO: 3868
  Description of Artificial Sequence: Synthetic Light chain variable region CDR L1 nucleic acid sequence

SEQ ID NO: 4141 - protein, 7 aa, Artificial Sequence
  Description of Artificial Sequence: Synthetic Light chain variable region CDR L2 amino acid sequence
WASTRES

SEQ ID NO: 4142 - DNA, 21 bp, Artificial Sequence
  Description of Artificial Sequence: Synthetic Light chain variable region CDR L2 nucleic acid sequence
tgggcatctacccgggaatcc

SEQ ID NO: 4143 - protein, 8 aa, Artificial Sequence
  Description of Artificial Sequence: Synthetic Light chain variable region CDR L3 amino acid sequence
KQSYSRRT

SEQ ID NO: 4144 - DNA, 24 bp, Artificial Sequence
  Description of Artificial Sequence: Synthetic Light chain variable region CDR L3 nucleic acid sequence
aagcaatcttattctcggagaact

SEQ ID NO: 4145 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatatttttacgacgtctggggccaaggaaccctggtcaccgtctcctca

SEQ ID NO: 4146 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYARYFYDVWGQGTLVTVSS

SEQ ID NO: 4147 - protein, 9 aa, Artificial Sequence
  Description of Artificial Sequence: Synthetic Heavy chain variable region CDR H1 amino acid sequence
FNIKDYYMH

SEQ ID NO: 4148 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4149 - protein, 17 aa, Artificial Sequence
  Description of Artificial Sequence: Synthetic Heavy chain variable region CDR H2 amino acid sequence
WIDLENGNTIYDPKFQG

SEQ ID NO: 4150 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4151 - protein, 12 aa, Artificial Sequence
  Description of Artificial Sequence: Synthetic Heavy chain variable region CDR H3 amino acid sequence
ARDGYARYFYDV

SEQ ID NO: 4152 - DNA, 36 bp, Artificial Sequence
  Description of Artificial Sequence: Synthetic Heavy chain variable region CDR H3 nucleic acid sequence
gcgagagatggatacgctagatatttttacgacgtc

SEQ ID NO: 4153 - DNA, 336 bp, Artificial Sequence; identical to SEQ ID NO: 3865
  Description of Artificial Sequence: Synthetic Light chain variable region nucleic acid sequence

SEQ ID NO: 4154 - protein, 112 aa, Artificial Sequence; identical to SEQ ID NO: 3866
  Description of Artificial Sequence: Synthetic Light chain variable region amino acid sequence

SEQ ID NO: 4155 - protein, 17 aa, Artificial Sequence
  Description of Artificial Sequence: Synthetic Light chain variable region CDR L1 amino acid sequence
KSSQSLLNSRTGKNYLA

SEQ ID NO: 4156 - DNA, 51 bp, Artificial Sequence; identical to SEQ ID NO: 3868
  Description of Artificial Sequence: Synthetic Light chain variable region CDR L1 nucleic acid sequence

SEQ ID NO: 4157 - protein, 7 aa, Artificial Sequence
  Description of Artificial Sequence: Synthetic Light chain variable region CDR L2 amino acid sequence
WASTRES

SEQ ID NO: 4158 - DNA, 21 bp, Artificial Sequence
  Description of Artificial Sequence: Synthetic Light chain variable region CDR L2 nucleic acid sequence
tgggcatctacccgggaatcc

SEQ ID NO: 4159 - protein, 8 aa, Artificial Sequence
  Description of Artificial Sequence: Synthetic Light chain variable region CDR L3 amino acid sequence
KQSYSRRT

SEQ ID NO: 4160 - DNA, 24 bp, Artificial Sequence
  Description of Artificial Sequence: Synthetic Light chain variable region CDR L3 nucleic acid sequence
aagcaatcttattctcggagaact

SEQ ID NO: 4161 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 4162 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYGRYFYDVWGQGTLVTVSS

SEQ ID NO: 4163 - protein, 9 aa, Artificial Sequence
  Description of Artificial Sequence: Synthetic Heavy chain variable region CDR H1 amino acid sequence
FNIKDYYMH

SEQ ID NO: 4164 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4165 - protein, 17 aa, Artificial Sequence
  Description of Artificial Sequence: Synthetic Heavy chain variable region CDR H2 amino acid sequence
WIDLENGNTIYDPKFQG

SEQ ID NO: 4166 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4167 - protein, 12 aa, Artificial Sequence
  Description of Artificial Sequence: Synthetic Heavy chain variable region CDR H3 amino acid sequence
ARDGYGRYFYDV

SEQ ID NO: 4168 - DNA, 36 bp, Artificial Sequence
  Description of Artificial Sequence: Synthetic Heavy chain variable region CDR H3 nucleic acid sequence
gcgagagatggatacgggagatatttttacgacgtg

SEQ ID NO: 4169 - DNA, 336 bp, Artificial Sequence; identical to SEQ ID NO: 3865
  Description of Artificial Sequence: Synthetic Light chain variable region nucleic acid sequence

SEQ ID NO: 4170 - protein, 112 aa, Artificial Sequence; identical to SEQ ID NO: 3866
  Description of Artificial Sequence: Synthetic Light chain variable region amino acid sequence

SEQ ID NO: 4171 - protein, 17 aa, Artificial Sequence
  Description of Artificial Sequence: Synthetic Light chain variable region CDR L1 amino acid sequence
KSSQSLLNSRTGKNYLA

SEQ ID NO: 4172 - DNA, 51 bp, Artificial Sequence; identical to SEQ ID NO: 3868
  Description of Artificial Sequence: Synthetic Light chain variable region CDR L1 nucleic acid sequence

SEQ ID NO: 4173 - protein, 7 aa, Artificial Sequence
  Description of Artificial Sequence: Synthetic Light chain variable region CDR L2 amino acid sequence
WASTRES

SEQ ID NO: 4174 - DNA, 21 bp, Artificial Sequence
  Description of Artificial Sequence: Synthetic Light chain variable region CDR L2 nucleic acid sequence
tgggcatctacccgggaatcc

SEQ ID NO: 4175 - protein, 8 aa, Artificial Sequence
  Description of Artificial Sequence: Synthetic Light chain variable region CDR L3 amino acid sequence
KQSYSRRT

SEQ ID NO: 4176 - DNA, 24 bp, Artificial Sequence
  Description of Artificial Sequence: Synthetic Light chain variable region CDR L3 nucleic acid sequence
aagcaatcttattctcggagaact

SEQ ID NO: 4177 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatatttttacgactactggggccaaggaaccctggtcaccgtctcctca

SEQ ID NO: 4178 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYARYFYDYWGQGTLVTVSS

SEQ ID NO: 4179 - protein, 9 aa, Artificial Sequence
  Description of Artificial Sequence: Synthetic Heavy chain variable region CDR H1 amino acid sequence
FNIKDYYMH

SEQ ID NO: 4180 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4181 - protein, 17 aa, Artificial Sequence
  Description of Artificial Sequence: Synthetic Heavy chain variable region CDR H2 amino acid sequence
WIDLENGNTIYDPKFQG

SEQ ID NO: 4182 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4183 - protein, 12 aa, Artificial Sequence
  Description of Artificial Sequence: Synthetic Heavy chain variable region CDR H3 amino acid sequence
ARDGYARYFYDY

SEQ ID NO: 4184 - DNA, 36 bp, Artificial Sequence
  Description of Artificial Sequence: Synthetic Heavy chain variable region CDR H3 nucleic acid sequence
gcgagagatggatacgctagatatttttacgactac

SEQ ID NO: 4185 - DNA, 336 bp, Artificial Sequence; identical to SEQ ID NO: 3865
  Description of Artificial Sequence: Synthetic Light chain variable region nucleic acid sequence

SEQ ID NO: 4186 - protein, 112 aa, Artificial Sequence; identical to SEQ ID NO: 3866
  Description of Artificial Sequence: Synthetic Light chain variable region amino acid sequence

SEQ ID NO: 4187 - protein, 17 aa, Artificial Sequence
  Description of Artificial Sequence: Synthetic Light chain variable region CDR L1 amino acid sequence
KSSQSLLNSRTGKNYLA

SEQ ID NO: 4188 - DNA, 51 bp, Artificial Sequence; identical to SEQ ID NO: 3868
  Description of Artificial Sequence: Synthetic Light chain variable region CDR L1 nucleic acid sequence

SEQ ID NO: 4189 - protein, 7 aa, Artificial Sequence
  Description of Artificial Sequence: Synthetic Light chain variable region CDR L2 amino acid sequence
WASTRES

SEQ ID NO: 4190 - DNA, 21 bp, Artificial Sequence
  Description of Artificial Sequence: Synthetic Light chain variable region CDR L2 nucleic acid sequence
tgggcatctacccgggaatcc

SEQ ID NO: 4191 - protein, 8 aa, Artificial Sequence
  Description of Artificial Sequence: Synthetic Light chain variable region CDR L3 amino acid sequence
KQSYSRRT

SEQ ID NO: 4192 - DNA, 24 bp, Artificial Sequence
  Description of Artificial Sequence: Synthetic Light chain variable region CDR L3 nucleic acid sequence
aagcaatcttattctcggagaact

SEQ ID NO: 4193 - DNA, 357 bp, Artificial Sequence; identical to SEQ ID NO: 4161
  Description of Artificial Sequence: Synthetic Heavy chain variable region nucleic acid sequence

SEQ ID NO: 4194 - protein, 119 aa, Artificial Sequence; identical to SEQ ID NO: 4162
  Description of Artificial Sequence: Synthetic Heavy chain variable region amino acid sequence

SEQ ID NO: 4195 - protein, 9 aa, Artificial Sequence
  Description of Artificial Sequence: Synthetic Heavy chain variable region CDR H1 amino acid sequence
FNIKDYYMH

SEQ ID NO: 4196 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4197 - protein, 17 aa, Artificial Sequence
  Description of Artificial Sequence: Synthetic Heavy chain variable region CDR H2 amino acid sequence
WIDLENGNTIYDPKFQG

SEQ ID NO: 4198 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4199 - protein, 12 aa, Artificial Sequence
  Description of Artificial Sequence: Synthetic Heavy chain variable region CDR H3 amino acid sequence
ARDGYGRYFYDV

SEQ ID NO: 4200 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4201 - DNA, 336 bp, Artificial Sequence; identical to SEQ ID NO: 3865
  Description of Artificial Sequence: Synthetic Light chain variable region nucleic acid sequence

SEQ ID NO: 4202 - protein, 112 aa, Artificial Sequence; identical to SEQ ID NO: 3866
  Description of Artificial Sequence: Synthetic Light chain variable region amino acid sequence

SEQ ID NO: 4203 - protein, 17 aa, Artificial Sequence
  Description of Artificial Sequence: Synthetic Light chain variable region CDR L1 amino acid sequence
KSSQSLLNSRTGKNYLA

SEQ ID NO: 4204 - DNA, 51 bp, Artificial Sequence; identical to SEQ ID NO: 3868
  Description of Artificial Sequence: Synthetic Light chain variable region CDR L1 nucleic acid sequence

SEQ ID NO: 4205 - protein, 7 aa, Artificial Sequence
  Description of Artificial Sequence: Synthetic Light chain variable region CDR L2 amino acid sequence
WASTRES

SEQ ID NO: 4206 - DNA, 21 bp, Artificial Sequence
  Description of Artificial Sequence: Synthetic Light chain variable region CDR L2 nucleic acid sequence
tgggcatctacccgggaatcc

SEQ ID NO: 4207 - protein, 8 aa, Artificial Sequence
  Description of Artificial Sequence: Synthetic Light chain variable region CDR L3 amino acid sequence
KQSYSRRT

SEQ ID NO: 4208 - DNA, 24 bp, Artificial Sequence
  Description of Artificial Sequence: Synthetic Light chain variable region CDR L3 nucleic acid sequence
aagcaatcttattctcggagaact

SEQ ID NO: 4209 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccctgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 4210 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDPENGNTIYDPKFQGRVTITRDTSASTAYMELSSLRSEDTAVYYCARDGYGRYFYDVWGQGTLVTVSS

SEQ ID NO: 4211 - protein, 9 aa, Artificial Sequence
  Description of Artificial Sequence: Synthetic Heavy chain variable region CDR H1 amino acid sequence
FNIKDYYMH

SEQ ID NO: 4212 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4213 - protein, 17 aa, Artificial Sequence
  Description of Artificial Sequence: Synthetic Heavy chain variable region CDR H2 amino acid sequence
WIDPENGNTIYDPKFQG

SEQ ID NO: 4214 - DNA, 51 bp, Artificial Sequence; identical to SEQ ID NO: 3414
  Description of Artificial Sequence: Synthetic Heavy chain variable region CDR H2 nucleic acid sequence

SEQ ID NO: 4215 - protein, 12 aa, Artificial Sequence
  Description of Artificial Sequence: Synthetic Heavy chain variable region CDR H3 amino acid sequence
ARDGYGRYFYDV

SEQ ID NO: 4216 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4217 - DNA, 336 bp, Artificial Sequence; identical to SEQ ID NO: 3865
  Description of Artificial Sequence: Synthetic Light chain variable region nucleic acid sequence

SEQ ID NO: 4218 - protein, 112 aa, Artificial Sequence; identical to SEQ ID NO: 3866
  Description of Artificial Sequence: Synthetic Light chain variable region amino acid sequence

SEQ ID NO: 4219 - protein, 17 aa, Artificial Sequence
  Description of Artificial Sequence: Synthetic Light chain variable region CDR L1 amino acid sequence
KSSQSLLNSRTGKNYLA

SEQ ID NO: 4220 - DNA, 51 bp, Artificial Sequence; identical to SEQ ID NO: 3868
  Description of Artificial Sequence: Synthetic Light chain variable region CDR L1 nucleic acid sequence

SEQ ID NO: 4221 - protein, 7 aa, Artificial Sequence
  Description of Artificial Sequence: Synthetic Light chain variable region CDR L2 amino acid sequence
WASTRES

SEQ ID NO: 4222 - DNA, 21 bp, Artificial Sequence
  Description of Artificial Sequence: Synthetic Light chain variable region CDR L2 nucleic acid sequence
tgggcatctacccgggaatcc

SEQ ID NO: 4223 - protein, 8 aa, Artificial Sequence
  Description of Artificial Sequence: Synthetic Light chain variable region CDR L3 amino acid sequence
KQSYSRRT

SEQ ID NO: 4224 - DNA, 24 bp, Artificial Sequence
  Description of Artificial Sequence: Synthetic Light chain variable region CDR L3 nucleic acid sequence
aagcaatcttattctcggagaact

SEQ ID NO: 4225 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggcccctggacaaaggcttgagtggataggatggatcgaccctgaaaatggtaacacaatctatgacccgaagtttcagggcagggtcaccataaccgcggacacgtccgccagcacagcctacatggagctgagcagcctgagatctgaagacacggcggtgtactactgcgctagagacggttacgggagatatttttacgacgtgtggggccaaggaaccctggtcaccgtctcctca

SEQ ID NO: 4226 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWIGWIDPENGNTIYDPKFQGRVTITADTSASTAYMELSSLRSEDTAVYYCARDGYGRYFYDVWGQGTLVTVSS

SEQ ID NO: 4227 - protein, 9 aa, Artificial Sequence
  Description of Artificial Sequence: Synthetic Heavy chain variable region CDR H1 amino acid sequence
FNIKDYYMH

SEQ ID NO: 4228 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4229 - protein, 17 aa, Artificial Sequence
  Description of Artificial Sequence: Synthetic Heavy chain variable region CDR H2 amino acid sequence
WIDPENGNTIYDPKFQG

SEQ ID NO: 4230 - DNA, 51 bp, Artificial Sequence; identical to SEQ ID NO: 3414
  Description of Artificial Sequence: Synthetic Heavy chain variable region CDR H2 nucleic acid sequence

SEQ ID NO: 4231 - protein, 12 aa, Artificial Sequence
  Description of Artificial Sequence: Synthetic Heavy chain variable region CDR H3 amino acid sequence
ARDGYGRYFYDV

SEQ ID NO: 4232 - DNA, 36 bp, Artificial Sequence
  Description of Artificial Sequence: Synthetic Heavy chain variable region CDR H3 nucleic acid sequence
gctagagacggttacgggagatatttttacgacgtg

SEQ ID NO: 4233 - DNA, 336 bp, Artificial Sequence; identical to SEQ ID NO: 3865
  Description of Artificial Sequence: Synthetic Light chain variable region nucleic acid sequence

SEQ ID NO: 4234 - protein, 112 aa, Artificial Sequence; identical to SEQ ID NO: 3866
  Description of Artificial Sequence: Synthetic Light chain variable region amino acid sequence

SEQ ID NO: 4235 - protein, 17 aa, Artificial Sequence
  Description of Artificial Sequence: Synthetic Light chain variable region CDR L1 amino acid sequence
KSSQSLLNSRTGKNYLA

SEQ ID NO: 4236 - DNA, 51 bp, Artificial Sequence; identical to SEQ ID NO: 3868
  Description of Artificial Sequence: Synthetic Light chain variable region CDR L1 nucleic acid sequence

SEQ ID NO: 4237 - protein, 7 aa, Artificial Sequence
  Description of Artificial Sequence: Synthetic Light chain variable region CDR L2 amino acid sequence
WASTRES

SEQ ID NO: 4238 - DNA, 21 bp, Artificial Sequence
  Description of Artificial Sequence: Synthetic Light chain variable region CDR L2 nucleic acid sequence
tgggcatctacccgggaatcc

SEQ ID NO: 4239 - protein, 8 aa, Artificial Sequence
  Description of Artificial Sequence: Synthetic Light chain variable region CDR L3 amino acid sequence
KQSYSRRT

SEQ ID NO: 4240 - DNA, 24 bp, Artificial Sequence
  Description of Artificial Sequence: Synthetic Light chain variable region CDR L3 nucleic acid sequence
aagcaatcttattctcggagaact

SEQ ID NO: 4241 - DNA, 357 bp, Artificial Sequence; identical to SEQ ID NO: 4161
  Description of Artificial Sequence: Synthetic Heavy chain variable region nucleic acid sequence

SEQ ID NO: 4242 - protein, 119 aa, Artificial Sequence; identical to SEQ ID NO: 4162
  Description of Artificial Sequence: Synthetic Heavy chain variable region amino acid sequence

SEQ ID NO: 4243 - protein, 9 aa, Artificial Sequence
  Description of Artificial Sequence: Synthetic Heavy chain variable region CDR H1 amino acid sequence
FNIKDYYMH

SEQ ID NO: 4244 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4245 - protein, 17 aa, Artificial Sequence
  Description of Artificial Sequence: Synthetic Heavy chain variable region CDR H2 amino acid sequence
WIDLENGNTIYDPKFQG

SEQ ID NO: 4246 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4247 - protein, 12 aa, Artificial Sequence
  Description of Artificial Sequence: Synthetic Heavy chain variable region CDR H3 amino acid sequence
ARDGYGRYFYDV

SEQ ID NO: 4248 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4249 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccggaaagaactacttagcttggtaccagcagaaaccaggacagcctcctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctctgagaactttcggcggagggaccaaggtcgagatcaaa

SEQ ID NO: 4250 - protein, 112 aa, Artificial Sequence
  Description of Artificial Sequence: Synthetic Light chain variable region amino acid sequence
DIVMTQSPDSLAVSLGERATINCKSSQSLLNSRTGKNYLAWYQQKPGQPPKLLIYWASTRESGVPDRFSGSGSGTDFTLTISSLQAEDVAVYYCKQSYSLRTFGGGTKVEIK

SEQ ID NO: 4251 - protein, 17 aa, Artificial Sequence
  Description of Artificial Sequence: Synthetic Light chain variable region CDR L1 amino acid sequence
KSSQSLLNSRTGKNYLA

SEQ ID NO: 4252 - DNA, 51 bp, Artificial Sequence; identical to SEQ ID NO: 3868
  Description of Artificial Sequence: Synthetic Light chain variable region CDR L1 nucleic acid sequence

SEQ ID NO: 4253 - protein, 7 aa, Artificial Sequence
  Description of Artificial Sequence: Synthetic Light chain variable region CDR L2 amino acid sequence
WASTRES

SEQ ID NO: 4254 - DNA, 21 bp, Artificial Sequence
  Description of Artificial Sequence: Synthetic Light chain variable region CDR L2 nucleic acid sequence
tgggcatctacccgggaatcc

SEQ ID NO: 4255 - protein, 8 aa, Artificial Sequence
  Description of Artificial Sequence: Synthetic Light chain variable region CDR L3 amino acid sequence
KQSYSLRT

SEQ ID NO: 4256 - DNA, 24 bp, Artificial Sequence
  Description of Artificial Sequence: Synthetic Light chain variable region CDR L3 nucleic acid sequence
aagcaatcttattctctgagaact

SEQ ID NO: 4257 - DNA, 357 bp, Artificial Sequence; identical to SEQ ID NO: 4209
  Description of Artificial Sequence: Synthetic Heavy chain variable region nucleic acid sequence

SEQ ID NO: 4258 - protein, 119 aa, Artificial Sequence; identical to SEQ ID NO: 4210
  Description of Artificial Sequence: Synthetic Heavy chain variable region amino acid sequence

SEQ ID NO: 4259 - protein, 9 aa, Artificial Sequence
  Description of Artificial Sequence: Synthetic Heavy chain variable region CDR H1 amino acid sequence
FNIKDYYMH

SEQ ID NO: 4260 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4261 - protein, 17 aa, Artificial Sequence
  Description of Artificial Sequence: Synthetic Heavy chain variable region CDR H2 amino acid sequence
WIDPENGNTIYDPKFQG

SEQ ID NO: 4262 - DNA, 51 bp, Artificial Sequence; identical to SEQ ID NO: 3414
  Description of Artificial Sequence: Synthetic Heavy chain variable region CDR H2 nucleic acid sequence

SEQ ID NO: 4263 - protein, 12 aa, Artificial Sequence
  Description of Artificial Sequence: Synthetic Heavy chain variable region CDR H3 amino acid sequence
ARDGYGRYFYDV

SEQ ID NO: 4264 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4265 - DNA, 336 bp, Artificial Sequence; identical to SEQ ID NO: 4249
  Description of Artificial Sequence: Synthetic Light chain variable region nucleic acid sequence

SEQ ID NO: 4266 - protein, 112 aa, Artificial Sequence; identical to SEQ ID NO: 4250
  Description of Artificial Sequence: Synthetic Light chain variable region amino acid sequence

SEQ ID NO: 4267 - protein, 17 aa, Artificial Sequence
  Description of Artificial Sequence: Synthetic Light chain variable region CDR L1 amino acid sequence
KSSQSLLNSRTGKNYLA

SEQ ID NO: 4268 - DNA, 51 bp, Artificial Sequence; identical to SEQ ID NO: 3868
  Description of Artificial Sequence: Synthetic Light chain variable region CDR L1 nucleic acid sequence

SEQ ID NO: 4269 - protein, 7 aa, Artificial Sequence
  Description of Artificial Sequence: Synthetic Light chain variable region CDR L2 amino acid sequence
WASTRES

SEQ ID NO: 4270 - DNA, 21 bp, Artificial Sequence
  Description of Artificial Sequence: Synthetic Light chain variable region CDR L2 nucleic acid sequence
tgggcatctacccgggaatcc

SEQ ID NO: 4271 - protein, 8 aa, Artificial Sequence
  Description of Artificial Sequence: Synthetic Light chain variable region CDR L3 amino acid sequence
KQSYSLRT

SEQ ID NO: 4272 - DNA, 24 bp, Artificial Sequence
  Description of Artificial Sequence: Synthetic Light chain variable region CDR L3 nucleic acid sequence
aagcaatcttattctctgagaact

SEQ ID NO: 4273 - DNA, 357 bp, Artificial Sequence; identical to SEQ ID NO: 4225
  Description of Artificial Sequence: Synthetic Heavy chain variable region nucleic acid sequence

SEQ ID NO: 4274 - protein, 119 aa, Artificial Sequence; identical to SEQ ID NO: 4226
  Description of Artificial Sequence: Synthetic Heavy chain variable region amino acid sequence

SEQ ID NO: 4275 - protein, 9 aa, Artificial Sequence
  Description of Artificial Sequence: Synthetic Heavy chain variable region CDR H1 amino acid sequence
FNIKDYYMH

SEQ ID NO: 4276 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4277 - protein, 17 aa, Artificial Sequence
  Description of Artificial Sequence: Synthetic Heavy chain variable region CDR H2 amino acid sequence
WIDPENGNTIYDPKFQG

SEQ ID NO: 4278 - DNA, 51 bp, Artificial Sequence; identical to SEQ ID NO: 3414
  Description of Artificial Sequence: Synthetic Heavy chain variable region CDR H2 nucleic acid sequence

SEQ ID NO: 4279 - protein, 12 aa, Artificial Sequence
  Description of Artificial Sequence: Synthetic Heavy chain variable region CDR H3 amino acid sequence
ARDGYGRYFYDV

SEQ ID NO: 4280 - DNA, 36 bp, Artificial Sequence; identical to SEQ ID NO: 4232
  Description of Artificial Sequence: Synthetic Heavy chain variable region CDR H3 nucleic acid sequence

SEQ ID NO: 4281 - DNA, 336 bp, Artificial Sequence; identical to SEQ ID NO: 4249
  Description of Artificial Sequence: Synthetic Light chain variable region nucleic acid sequence

SEQ ID NO: 4282 - protein, 112 aa, Artificial Sequence; identical to SEQ ID NO: 4250
  Description of Artificial Sequence: Synthetic Light chain variable region amino acid sequence

SEQ ID NO: 4283 - protein, 17 aa, Artificial Sequence
  Description of Artificial Sequence: Synthetic Light chain variable region CDR L1 amino acid sequence
KSSQSLLNSRTGKNYLA

SEQ ID NO: 4284 - DNA, 51 bp, Artificial Sequence; identical to SEQ ID NO: 3868
  Description of Artificial Sequence: Synthetic Light chain variable region CDR L1 nucleic acid sequence

SEQ ID NO: 4285 - protein, 7 aa, Artificial Sequence
  Description of Artificial Sequence: Synthetic Light chain variable region CDR L2 amino acid sequence
WASTRES

SEQ ID NO: 4286 - DNA, 21 bp, Artificial Sequence
  Description of Artificial Sequence: Synthetic Light chain variable region CDR L2 nucleic acid sequence
tgggcatctacccgggaatcc

SEQ ID NO: 4287 - protein, 8 aa, Artificial Sequence
  Description of Artificial Sequence: Synthetic Light chain variable region CDR L3 amino acid sequence
KQSYSLRT

SEQ ID NO: 4288 - DNA, 24 bp, Artificial Sequence
  Description of Artificial Sequence: Synthetic Light chain variable region CDR L3 nucleic acid sequence
aagcaatcttattctctgagaact

SEQ ID NO: 4289 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaagaaggtaacacaatctatgacccgaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 4290 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLEEGNTIYDPKFQGRVTITRDTSASTAYMELSSLRSEDTAVYYCARDGYGRYFYDVWGQGTLVTVSS

SEQ ID NO: 4291 - protein, 9 aa, Artificial Sequence
  Description of Artificial Sequence: Synthetic Heavy chain variable region CDR H1 amino acid sequence
FNIKDYYMH

SEQ ID NO: 4292 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4293 - protein, 17 aa, Artificial Sequence
  Description of Artificial Sequence: Synthetic Heavy chain variable region CDR H2 amino acid sequence
WIDLEEGNTIYDPKFQG

SEQ ID NO: 4294 - DNA, 51 bp, Artificial Sequence
  Description of Artificial Sequence: Synthetic Heavy chain variable region CDR H2 nucleic acid sequence
tggatcgaccttgaagaaggtaacacaatctatgacccgaagtttcagggc

SEQ ID NO: 4295 - protein, 12 aa, Artificial Sequence
  Description of Artificial Sequence: Synthetic Heavy chain variable region CDR H3 amino acid sequence
ARDGYGRYFYDV

SEQ ID NO: 4296 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4297 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttagaaagcagaaccggaaagaactacttagcttggtaccagcagaaaccaggacagcctcctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctcggagaactttcggcggagggaccaaggtcgagatcaaa

SEQ ID NO: 4298 - protein, 112 aa, Artificial Sequence
  Description of Artificial Sequence: Synthetic Light chain variable region amino acid sequence
DIVMTQSPDSLAVSLGERATINCKSSQSLLESRTGKNYLAWYQQKPGQPPKLLIYWASTRESGVPDRFSGSGSGTDFTLTISSLQAEDVAVYYCKQSYSRRTFGGGTKVEIK

SEQ ID NO: 4299 - protein, 17 aa, Artificial Sequence
  Description of Artificial Sequence: Synthetic Light chain variable region CDR L1 amino acid sequence
KSSQSLLESRTGKNYLA

SEQ ID NO: 4300 - DNA, 51 bp, Artificial Sequence
  Description of Artificial Sequence: Synthetic Light chain variable region CDR L1 nucleic acid sequence
aagtccagccagagtcttttagaaagcagaaccggaaagaactacttagct

SEQ ID NO: 4301 - protein, 7 aa, Artificial Sequence
  Description of Artificial Sequence: Synthetic Light chain variable region CDR L2 amino acid sequence
WASTRES

SEQ ID NO: 4302 - DNA, 21 bp, Artificial Sequence
  Description of Artificial Sequence: Synthetic Light chain variable region CDR L2 nucleic acid sequence
tgggcatctacccgggaatcc

SEQ ID NO: 4303 - protein, 8 aa, Artificial Sequence
  Description of Artificial Sequence: Synthetic Light chain variable region CDR L3 amino acid sequence
KQSYSRRT

SEQ ID NO: 4304 - DNA, 24 bp, Artificial Sequence
  Description of Artificial Sequence: Synthetic Light chain variable region CDR L3 nucleic acid sequence
aagcaatcttattctcggagaact

SEQ ID NO: 4305 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatcaaccgaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 4306 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYQPKFQGRVTITRDTSASTAYMELSSLRSEDTAVYYCARDGYGRYFYDVWGQGTLVTVSS

SEQ ID NO: 4307 - protein, 9 aa, Artificial Sequence
  Description of Artificial Sequence: Synthetic Heavy chain variable region CDR H1 amino acid sequence
FNIKDYYMH

SEQ ID NO: 4308 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4309 - protein, 17 aa, Artificial Sequence
  Description of Artificial Sequence: Synthetic Heavy chain variable region CDR H2 amino acid sequence
WIDLENGNTIYQPKFQG

SEQ ID NO: 4310 - DNA, 51 bp, Artificial Sequence
  Description of Artificial Sequence: Synthetic Heavy chain variable region CDR H2 nucleic acid sequence
tggatcgaccttgaaaatggtaacacaatctatcaaccgaagtttcagggc

SEQ ID NO: 4311 - protein, 12 aa, Artificial Sequence
  Description of Artificial Sequence: Synthetic Heavy chain variable region CDR H3 amino acid sequence
ARDGYGRYFYDV

SEQ ID NO: 4312 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4313 - DNA, 336 bp, Artificial Sequence; identical to SEQ ID NO: 4297
  Description of Artificial Sequence: Synthetic Light chain variable region nucleic acid sequence

SEQ ID NO: 4314 - protein, 112 aa, Artificial Sequence; identical to SEQ ID NO: 4298
  Description of Artificial Sequence: Synthetic Light chain variable region amino acid sequence

SEQ ID NO: 4315 - protein, 17 aa, Artificial Sequence
  Description of Artificial Sequence: Synthetic Light chain variable region CDR L1 amino acid sequence
KSSQSLLESRTGKNYLA

SEQ ID NO: 4316 - DNA, 51 bp, Artificial Sequence; identical to SEQ ID NO: 4300
  Description of Artificial Sequence: Synthetic Light chain variable region CDR L1 nucleic acid sequence

SEQ ID NO: 4317 - protein, 7 aa, Artificial Sequence
  Description of Artificial Sequence: Synthetic Light chain variable region CDR L2 amino acid sequence
WASTRES

SEQ ID NO: 4318 - DNA, 21 bp, Artificial Sequence
  Description of Artificial Sequence: Synthetic Light chain variable region CDR L2 nucleic acid sequence
tgggcatctacccgggaatcc

SEQ ID NO: 4319 - protein, 8 aa, Artificial Sequence
  Description of Artificial Sequence: Synthetic Light chain variable region CDR L3 amino acid sequence
KQSYSRRT

SEQ ID NO: 4320 - DNA, 24 bp, Artificial Sequence
  Description of Artificial Sequence: Synthetic Light chain variable region CDR L3 nucleic acid sequence
aagcaatcttattctcggagaact

SEQ ID NO: 4321 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagaaggatacgggagatatttttacgacgtgtggggccaaggaaccctggtcaccgtctcctca

SEQ ID NO: 4322 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCAREGYGRYFYDVWGQGTLVTVSS

SEQ ID NO: 4323 - protein, 9 aa, Artificial Sequence
  Description of Artificial Sequence: Synthetic Heavy chain variable region CDR H1 amino acid sequence
FNIKDYYMH

SEQ ID NO: 4324 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4325 - protein, 17 aa, Artificial Sequence
  Description of Artificial Sequence: Synthetic Heavy chain variable region CDR H2 amino acid sequence
WIDLENGNTIYDPKFQG

SEQ ID NO: 4326 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4327 - protein, 12 aa, Artificial Sequence
  Description of Artificial Sequence: Synthetic Heavy chain variable region CDR H3 amino acid sequence
AREGYGRYFYDV

SEQ ID NO: 4328 - DNA, 36 bp, Artificial Sequence
  Description of Artificial Sequence: Synthetic Heavy chain variable region CDR H3 nucleic acid sequence
gcgagagaaggatacgggagatatttttacgacgtg

SEQ ID NO: 4329 - DNA, 336 bp, Artificial Sequence; identical to SEQ ID NO: 4297
  Description of Artificial Sequence: Synthetic Light chain variable region nucleic acid sequence

SEQ ID NO: 4330 - protein, 112 aa, Artificial Sequence; identical to SEQ ID NO: 4298
  Description of Artificial Sequence: Synthetic Light chain variable region amino acid sequence

SEQ ID NO: 4331 - protein, 17 aa, Artificial Sequence
  Description of Artificial Sequence: Synthetic Light chain variable region CDR L1 amino acid sequence
KSSQSLLESRTGKNYLA

SEQ ID NO: 4332 - DNA, 51 bp, Artificial Sequence; identical to SEQ ID NO: 4300
  Description of Artificial Sequence: Synthetic Light chain variable region CDR L1 nucleic acid sequence

SEQ ID NO: 4333 - protein, 7 aa, Artificial Sequence
  Description of Artificial Sequence: Synthetic Light chain variable region CDR L2 amino acid sequence
WASTRES

SEQ ID NO: 4334 - DNA, 21 bp, Artificial Sequence
  Description of Artificial Sequence: Synthetic Light chain variable region CDR L2 nucleic acid sequence
tgggcatctacccgggaatcc

SEQ ID NO: 4335 - protein, 8 aa, Artificial Sequence
  Description of Artificial Sequence: Synthetic Light chain variable region CDR L3 amino acid sequence
KQSYSRRT

SEQ ID NO: 4336 - DNA, 24 bp, Artificial Sequence
  Description of Artificial Sequence: Synthetic Light chain variable region CDR L3 nucleic acid sequence
aagcaatcttattctcggagaact

SEQ ID NO: 4337 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaagaaggtaacacaatctatcaaccgaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 4338 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLEEGNTIYQPKFQGRVTITRDTSASTAYMELSSLRSEDTAVYYCARDGYGRYFYDVWGQGTLVTVSS

SEQ ID NO: 4339 - protein, 9 aa, Artificial Sequence
  Description of Artificial Sequence: Synthetic Heavy chain variable region CDR H1 amino acid sequence
FNIKDYYMH

SEQ ID NO: 4340 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4341 - protein, 17 aa, Artificial Sequence
  Description of Artificial Sequence: Synthetic Heavy chain variable region CDR H2 amino acid sequence
WIDLEEGNTIYQPKFQG

SEQ ID NO: 4342 - DNA, 51 bp, Artificial Sequence
  Description of Artificial Sequence: Synthetic Heavy chain variable region CDR H2 nucleic acid sequence
tggatcgaccttgaagaaggtaacacaatctatcaaccgaagtttcagggc

SEQ ID NO: 4343 - protein, 12 aa, Artificial Sequence
  Description of Artificial Sequence: Synthetic Heavy chain variable region CDR H3 amino acid sequence
ARDGYGRYFYDV

SEQ ID NO: 4344 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4345 - DNA, 336 bp, Artificial Sequence; identical to SEQ ID NO: 4297
  Description of Artificial Sequence: Synthetic Light chain variable region nucleic acid sequence

SEQ ID NO: 4346 - protein, 112 aa, Artificial Sequence; identical to SEQ ID NO: 4298
  Description of Artificial Sequence: Synthetic Light chain variable region amino acid sequence

SEQ ID NO: 4347 - protein, 17 aa, Artificial Sequence
  Description of Artificial Sequence: Synthetic Light chain variable region CDR L1 amino acid sequence
KSSQSLLESRTGKNYLA

SEQ ID NO: 4348 - DNA, 51 bp, Artificial Sequence; identical to SEQ ID NO: 4300
  Description of Artificial Sequence: Synthetic Light chain variable region CDR L1 nucleic acid sequence

SEQ ID NO: 4349 - protein, 7 aa, Artificial Sequence
  Description of Artificial Sequence: Synthetic Light chain variable region CDR L2 amino acid sequence
WASTRES

SEQ ID NO: 4350 - DNA, 21 bp, Artificial Sequence
  Description of Artificial Sequence: Synthetic Light chain variable region CDR L2 nucleic acid sequence
tgggcatctacccgggaatcc

SEQ ID NO: 4351 - protein, 8 aa, Artificial Sequence
  Description of Artificial Sequence: Synthetic Light chain variable region CDR L3 amino acid sequence
KQSYSRRT

SEQ ID NO: 4352 - DNA, 24 bp, Artificial Sequence
  Description of Artificial Sequence: Synthetic Light chain variable region CDR L3 nucleic acid sequence
aagcaatcttattctcggagaact

SEQ ID NO: 4353 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatcaaccgaagtttcagggcagggtcaccataaccagggacacgtccgccagcacagcctacatggagctgagcagcctgagatctgaagacacggcggtgtactactgcgcgagagaaggatacgggagatatttttacgacgtgtggggccaaggaaccctggtcaccgtctcctca

SEQ ID NO: 4354 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYQPKFQGRVTITRDTSASTAYMELSSLRSEDTAVYYCAREGYGRYFYDVWGQGTLVTVSS

SEQ ID NO: 4355 - protein, 9 aa, Artificial Sequence
  Description of Artificial Sequence: Synthetic Heavy chain variable region CDR H1 amino acid sequence
FNIKDYYMH

SEQ ID NO: 4356 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4357 - protein, 17 aa, Artificial Sequence
  Description of Artificial Sequence: Synthetic Heavy chain variable region CDR H2 amino acid sequence
WIDLENGNTIYQPKFQG

SEQ ID NO: 4358 - DNA, 51 bp, Artificial Sequence; identical to SEQ ID NO: 4310
  Description of Artificial Sequence: Synthetic Heavy chain variable region CDR H2 nucleic acid sequence

SEQ ID NO: 4359 - protein, 12 aa, Artificial Sequence
  Description of Artificial Sequence: Synthetic Heavy chain variable region CDR H3 amino acid sequence
AREGYGRYFYDV

SEQ ID NO: 4360 - DNA, 36 bp, Artificial Sequence; identical to SEQ ID NO: 4328
  Description of Artificial Sequence: Synthetic Heavy chain variable region CDR H3 nucleic acid sequence

SEQ ID NO: 4361 - DNA, 336 bp, Artificial Sequence; identical to SEQ ID NO: 4297
  Description of Artificial Sequence: Synthetic Light chain variable region nucleic acid sequence

SEQ ID NO: 4362 - protein, 112 aa, Artificial Sequence; identical to SEQ ID NO: 4298
  Description of Artificial Sequence: Synthetic Light chain variable region amino acid sequence

SEQ ID NO: 4363 - protein, 17 aa, Artificial Sequence
  Description of Artificial Sequence: Synthetic Light chain variable region CDR L1 amino acid sequence
KSSQSLLESRTGKNYLA

SEQ ID NO: 4364 - DNA, 51 bp, Artificial Sequence; identical to SEQ ID NO: 4300
  Description of Artificial Sequence: Synthetic Light chain variable region CDR L1 nucleic acid sequence

SEQ ID NO: 4365 - protein, 7 aa, Artificial Sequence
  Description of Artificial Sequence: Synthetic Light chain variable region CDR L2 amino acid sequence
WASTRES

SEQ ID NO: 4366 - DNA, 21 bp, Artificial Sequence
  Description of Artificial Sequence: Synthetic Light chain variable region CDR L2 nucleic acid sequence
tgggcatctacccgggaatcc

SEQ ID NO: 4367 - protein, 8 aa, Artificial Sequence
  Description of Artificial Sequence: Synthetic Light chain variable region CDR L3 amino acid sequence
KQSYSRRT

SEQ ID NO: 4368 - DNA, 24 bp, Artificial Sequence
  Description of Artificial Sequence: Synthetic Light chain variable region CDR L3 nucleic acid sequence
aagcaatcttattctcggagaact

SEQ ID NO: 4369 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaagaaggtaacacaatctatgacccgaagtttcagggcagggtcaccataaccagggacacgtccgccagcacagcctacatggagctgagcagcctgagatctgaagacacggcggtgtactactgcgcgagagaaggatacgggagatatttttacgacgtgtggggccaaggaaccctggtcaccgtctcctca

SEQ ID NO: 4370 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLEEGNTIYDPKFQGRVTITRDTSASTAYMELSSLRSEDTAVYYCAREGYGRYFYDVWGQGTLVTVSS

SEQ ID NO: 4371 - protein, 9 aa, Artificial Sequence
  Description of Artificial Sequence: Synthetic Heavy chain variable region CDR H1 amino acid sequence
FNIKDYYMH

SEQ ID NO: 4372 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4373 - protein, 17 aa, Artificial Sequence
  Description of Artificial Sequence: Synthetic Heavy chain variable region CDR H2 amino acid sequence
WIDLEEGNTIYDPKFQG

SEQ ID NO: 4374 - DNA, 51 bp, Artificial Sequence; identical to SEQ ID NO: 4294
  Description of Artificial Sequence: Synthetic Heavy chain variable region CDR H2 nucleic acid sequence

SEQ ID NO: 4375 - protein, 12 aa, Artificial Sequence
  Description of Artificial Sequence: Synthetic Heavy chain variable region CDR H3 amino acid sequence
AREGYGRYFYDV

SEQ ID NO: 4376 - DNA, 36 bp, Artificial Sequence; identical to SEQ ID NO: 4328
  Description of Artificial Sequence: Synthetic Heavy chain variable region CDR H3 nucleic acid sequence

SEQ ID NO: 4377 - DNA, 336 bp, Artificial Sequence; identical to SEQ ID NO: 4297
  Description of Artificial Sequence: Synthetic Light chain variable region nucleic acid sequence

SEQ ID NO: 4378 - protein, 112 aa, Artificial Sequence; identical to SEQ ID NO: 4298
  Description of Artificial Sequence: Synthetic Light chain variable region amino acid sequence

SEQ ID NO: 4379 - protein, 17 aa, Artificial Sequence
  Description of Artificial Sequence: Synthetic Light chain variable region CDR L1 amino acid sequence
KSSQSLLESRTGKNYLA

SEQ ID NO: 4380 - DNA, 51 bp, Artificial Sequence; identical to SEQ ID NO: 4300
  Description of Artificial Sequence: Synthetic Light chain variable region CDR L1 nucleic acid sequence

SEQ ID NO: 4381 - protein, 7 aa, Artificial Sequence
  Description of Artificial Sequence: Synthetic Light chain variable region CDR L2 amino acid sequence
WASTRES

SEQ ID NO: 4382 - DNA, 21 bp, Artificial Sequence
  Description of Artificial Sequence: Synthetic Light chain variable region CDR L2 nucleic acid sequence
tgggcatctacccgggaatcc

SEQ ID NO: 4383 - protein, 8 aa, Artificial Sequence
  Description of Artificial Sequence: Synthetic Light chain variable region CDR L3 amino acid sequence
KQSYSRRT

SEQ ID NO: 4384 - DNA, 24 bp, Artificial Sequence
  Description of Artificial Sequence: Synthetic Light chain variable region CDR L3 nucleic acid sequence
aagcaatcttattctcggagaact

SEQ ID NO: 4385 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaagaaggtaacacaatctatcaaccgaagtttcagggcagggtcaccataaccagggacacgtccgccagcacagcctacatggagctgagcagcctgagatctgaagacacggcggtgtactactgcgcgagagaaggatacgggagatatttttacgacgtgtggggccaaggaaccctggtcaccgtctcctca

SEQ ID NO: 4386 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLEEGNTIYQPKFQGRVTITRDTSASTAYMELSSLRSEDTAVYYCAREGYGRYFYDVWGQGTLVTVSS

SEQ ID NO: 4387 - protein, 9 aa, Artificial Sequence
  Description of Artificial Sequence: Synthetic Heavy chain variable region CDR H1 amino acid sequence
FNIKDYYMH

SEQ ID NO: 4388 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4389 - protein, 17 aa, Artificial Sequence
  Description of Artificial Sequence: Synthetic Heavy chain variable region CDR H2 amino acid sequence
WIDLEEGNTIYQPKFQG

SEQ ID NO: 4390 - DNA, 51 bp, Artificial Sequence; identical to SEQ ID NO: 4342
  Description of Artificial Sequence: Synthetic Heavy chain variable region CDR H2 nucleic acid sequence

SEQ ID NO: 4391 - protein, 12 aa, Artificial Sequence
  Description of Artificial Sequence: Synthetic Heavy chain variable region CDR H3 amino acid sequence
AREGYGRYFYDV

SEQ ID NO: 4392 - DNA, 36 bp, Artificial Sequence; identical to SEQ ID NO: 4328
  Description of Artificial Sequence: Synthetic Heavy chain variable region CDR H3 nucleic acid sequence

SEQ ID NO: 4393 - DNA, 336 bp, Artificial Sequence; identical to SEQ ID NO: 4297
  Description of Artificial Sequence: Synthetic Light chain variable region nucleic acid sequence

SEQ ID NO: 4394 - protein, 112 aa, Artificial Sequence; identical to SEQ ID NO: 4298
  Description of Artificial Sequence: Synthetic Light chain variable region amino acid sequence

SEQ ID NO: 4395 - protein, 17 aa, Artificial Sequence
  Description of Artificial Sequence: Synthetic Light chain variable region CDR L1 amino acid sequence
KSSQSLLESRTGKNYLA

SEQ ID NO: 4396 - DNA, 51 bp, Artificial Sequence; identical to SEQ ID NO: 4300
  Description of Artificial Sequence: Synthetic Light chain variable region CDR L1 nucleic acid sequence

SEQ ID NO: 4397 - protein, 7 aa, Artificial Sequence
  Description of Artificial Sequence: Synthetic Light chain variable region CDR L2 amino acid sequence
WASTRES

SEQ ID NO: 4398 - DNA, 21 bp, Artificial Sequence
  Description of Artificial Sequence: Synthetic Light chain variable region CDR L2 nucleic acid sequence
tgggcatctacccgggaatcc

SEQ ID NO: 4399 - protein, 8 aa, Artificial Sequence
  Description of Artificial Sequence: Synthetic Light chain variable region CDR L3 amino acid sequence
KQSYSRRT

SEQ ID NO: 4400 - DNA, 24 bp, Artificial Sequence
  Description of Artificial Sequence: Synthetic Light chain variable region CDR L3 nucleic acid sequence
aagcaatcttattctcggagaact

SEQ ID NO: 4401 - DNA, 357 bp, Artificial Sequence; identical to SEQ ID NO: 4161
  Description of Artificial Sequence: Synthetic Heavy chain variable region nucleic acid sequence

SEQ ID NO: 4402 - protein, 119 aa, Artificial Sequence; identical to SEQ ID NO: 4162
  Description of Artificial Sequence: Synthetic Heavy chain variable region amino acid sequence

SEQ ID NO: 4403 - protein, 9 aa, Artificial Sequence
  Description of Artificial Sequence: Synthetic Heavy chain variable region CDR H1 amino acid sequence
FNIKDYYMH

SEQ ID NO: 4404 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4405 - protein, 17 aa, Artificial Sequence
  Description of Artificial Sequence: Synthetic Heavy chain variable region CDR H2 amino acid sequence
WIDLENGNTIYDPKFQG

SEQ ID NO: 4406 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4407 - protein, 12 aa, Artificial Sequence
  Description of Artificial Sequence: Synthetic Heavy chain variable region CDR H3 amino acid sequence
ARDGYGRYFYDV

SEQ ID NO: 4408 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4409 - DNA, 336 bp, Artificial Sequence; identical to SEQ ID NO: 4297
  Description of Artificial Sequence: Synthetic Light chain variable region nucleic acid sequence

SEQ ID NO: 4410 - protein, 112 aa, Artificial Sequence; identical to SEQ ID NO: 4298
  Description of Artificial Sequence: Synthetic Light chain variable region amino acid sequence

SEQ ID NO: 4411 - protein, 17 aa, Artificial Sequence
  Description of Artificial Sequence: Synthetic Light chain variable region CDR L1 amino acid sequence
KSSQSLLESRTGKNYLA

SEQ ID NO: 4412 - DNA, 51 bp, Artificial Sequence; identical to SEQ ID NO: 4300
  Description of Artificial Sequence: Synthetic Light chain variable region CDR L1 nucleic acid sequence

SEQ ID NO: 4413 - protein, 7 aa, Artificial Sequence
  Description of Artificial Sequence: Synthetic Light chain variable region CDR L2 amino acid sequence
WASTRES

SEQ ID NO: 4414 - DNA, 21 bp, Artificial Sequence
  Description of Artificial Sequence: Synthetic Light chain variable region CDR L2 nucleic acid sequence
tgggcatctacccgggaatcc

SEQ ID NO: 4415 - protein, 8 aa, Artificial Sequence
  Description of Artificial Sequence: Synthetic Light chain variable region CDR L3 amino acid sequence
KQSYSRRT

SEQ ID NO: 4416 - DNA, 24 bp, Artificial Sequence
  Description of Artificial Sequence: Synthetic Light chain variable region CDR L3 nucleic acid sequence
aagcaatcttattctcggagaact

SEQ ID NO: 4417 - DNA, 357 bp, Artificial Sequence; identical to SEQ ID NO: 4289
  Description of Artificial Sequence: Synthetic Heavy chain variable region nucleic acid sequence

SEQ ID NO: 4418 - protein, 119 aa, Artificial Sequence; identical to SEQ ID NO: 4290
  Description of Artificial Sequence: Synthetic Heavy chain variable region amino acid sequence

SEQ ID NO: 4419 - protein, 9 aa, Artificial Sequence
  Description of Artificial Sequence: Synthetic Heavy chain variable region CDR H1 amino acid sequence
FNIKDYYMH

SEQ ID NO: 4420 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4421 - protein, 17 aa, Artificial Sequence
  Description of Artificial Sequence: Synthetic Heavy chain variable region CDR H2 amino acid sequence
WIDLEEGNTIYDPKFQG

SEQ ID NO: 4422 - DNA, 51 bp, Artificial Sequence; identical to SEQ ID NO: 4294
  Description of Artificial Sequence: Synthetic Heavy chain variable region CDR H2 nucleic acid sequence

SEQ ID NO: 4423 - protein, 12 aa, Artificial Sequence
  Description of Artificial Sequence: Synthetic Heavy chain variable region CDR H3 amino acid sequence
ARDGYGRYFYDV

SEQ ID NO: 4424 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4425 - DNA, 336 bp, Artificial Sequence; identical to SEQ ID NO: 3865
  Description of Artificial Sequence: Synthetic Light chain variable region nucleic acid sequence

SEQ ID NO: 4426 - protein, 112 aa, Artificial Sequence; identical to SEQ ID NO: 3866
  Description of Artificial Sequence: Synthetic Light chain variable region amino acid sequence

SEQ ID NO: 4427 - protein, 17 aa, Artificial Sequence
  Description of Artificial Sequence: Synthetic Light chain variable region CDR L1 amino acid sequence
KSSQSLLNSRTGKNYLA

SEQ ID NO: 4428 - DNA, 51 bp, Artificial Sequence; identical to SEQ ID NO: 3868
  Description of Artificial Sequence: Synthetic Light chain variable region CDR L1 nucleic acid sequence

SEQ ID NO: 4429 - protein, 7 aa, Artificial Sequence
  Description of Artificial Sequence: Synthetic Light chain variable region CDR L2 amino acid sequence
WASTRES

SEQ ID NO: 4430 - DNA, 21 bp, Artificial Sequence
  Description of Artificial Sequence: Synthetic Light chain variable region CDR L2 nucleic acid sequence
tgggcatctacccgggaatcc

SEQ ID NO: 4431 - protein, 8 aa, Artificial Sequence
  Description of Artificial Sequence: Synthetic Light chain variable region CDR L3 amino acid sequence
KQSYSRRT

SEQ ID NO: 4432 - DNA, 24 bp, Artificial Sequence
  Description of Artificial Sequence: Synthetic Light chain variable region CDR L3 nucleic acid sequence
aagcaatcttattctcggagaact

SEQ ID NO: 4433 - DNA, 357 bp, Artificial Sequence; identical to SEQ ID NO: 4305
  Description of Artificial Sequence: Synthetic Heavy chain variable region nucleic acid sequence

SEQ ID NO: 4434 - protein, 119 aa, Artificial Sequence; identical to SEQ ID NO: 4306
  Description of Artificial Sequence: Synthetic Heavy chain variable region amino acid sequence

SEQ ID NO: 4435 - protein, 9 aa, Artificial Sequence
  Description of Artificial Sequence: Synthetic Heavy chain variable region CDR H1 amino acid sequence
FNIKDYYMH

SEQ ID NO: 4436 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4437 - protein, 17 aa, Artificial Sequence
  Description of Artificial Sequence: Synthetic Heavy chain variable region CDR H2 amino acid sequence
WIDLENGNTIYQPKFQG

SEQ ID NO: 4438 - DNA, 51 bp, Artificial Sequence; identical to SEQ ID NO: 4310
  Description of Artificial Sequence: Synthetic Heavy chain variable region CDR H2 nucleic acid sequence

SEQ ID NO: 4439 - protein, 12 aa, Artificial Sequence
  Description of Artificial Sequence: Synthetic Heavy chain variable region CDR H3 amino acid sequence
ARDGYGRYFYDV

SEQ ID NO: 4440 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4441 - DNA, 336 bp, Artificial Sequence; identical to SEQ ID NO: 3865
  Description of Artificial Sequence: Synthetic Light chain variable region nucleic acid sequence

SEQ ID NO: 4442 - protein, 112 aa, Artificial Sequence; identical to SEQ ID NO: 3866
  Description of Artificial Sequence: Synthetic Light chain variable region amino acid sequence

SEQ ID NO: 4443 - protein, 17 aa, Artificial Sequence
  Description of Artificial Sequence: Synthetic Light chain variable region CDR L1 amino acid sequence
KSSQSLLNSRTGKNYLA

SEQ ID NO: 4444 - DNA, 51 bp, Artificial Sequence; identical to SEQ ID NO: 3868
  Description of Artificial Sequence: Synthetic Light chain variable region CDR L1 nucleic acid sequence

SEQ ID NO: 4445 - protein, 7 aa, Artificial Sequence
  Description of Artificial Sequence: Synthetic Light chain variable region CDR L2 amino acid sequence
WASTRES

SEQ ID NO: 4446 - DNA, 21 bp, Artificial Sequence
  Description of Artificial Sequence: Synthetic Light chain variable region CDR L2 nucleic acid sequence
tgggcatctacccgggaatcc

SEQ ID NO: 4447 - protein, 8 aa, Artificial Sequence
  Description of Artificial Sequence: Synthetic Light chain variable region CDR L3 amino acid sequence
KQSYSRRT

SEQ ID NO: 4448 - DNA, 24 bp, Artificial Sequence
  Description of Artificial Sequence: Synthetic Light chain variable region CDR L3 nucleic acid sequence
aagcaatcttattctcggagaact

SEQ ID NO: 4449 - DNA, 357 bp, Artificial Sequence; identical to SEQ ID NO: 4321
  Description of Artificial Sequence: Synthetic Heavy chain variable region nucleic acid sequence

SEQ ID NO: 4450 - protein, 119 aa, Artificial Sequence; identical to SEQ ID NO: 4322
  Description of Artificial Sequence: Synthetic Heavy chain variable region amino acid sequence

SEQ ID NO: 4451 - protein, 9 aa, Artificial Sequence
  Description of Artificial Sequence: Synthetic Heavy chain variable region CDR H1 amino acid sequence
FNIKDYYMH

SEQ ID NO: 4452 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4453 - protein, 17 aa, Artificial Sequence
  Description of Artificial Sequence: Synthetic Heavy chain variable region CDR H2 amino acid sequence
WIDLENGNTIYDPKFQG

SEQ ID NO: 4454 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4455 - protein, 12 aa, Artificial Sequence
  Description of Artificial Sequence: Synthetic Heavy chain variable region CDR H3 amino acid sequence
AREGYGRYFYDV

SEQ ID NO: 4456 - DNA, 36 bp, Artificial Sequence; identical to SEQ ID NO: 4328
  Description of Artificial Sequence: Synthetic Heavy chain variable region CDR H3 nucleic acid sequence

SEQ ID NO: 4457 - DNA, 336 bp, Artificial Sequence; identical to SEQ ID NO: 3865
  Description of Artificial Sequence: Synthetic Light chain variable region nucleic acid sequence

SEQ ID NO: 4458 - protein, 112 aa, Artificial Sequence; identical to SEQ ID NO: 3866
  Description of Artificial Sequence: Synthetic Light chain variable region amino acid sequence

SEQ ID NO: 4459 - protein, 17 aa, Artificial Sequence
  Description of Artificial Sequence: Synthetic Light chain variable region CDR L1 amino acid sequence
KSSQSLLNSRTGKNYLA

SEQ ID NO: 4460 - DNA, 51 bp, Artificial Sequence; identical to SEQ ID NO: 3868
  Description of Artificial Sequence: Synthetic Light chain variable region CDR L1 nucleic acid sequence

SEQ ID NO: 4461 - protein, 7 aa, Artificial Sequence
  Description of Artificial Sequence: Synthetic Light chain variable region CDR L2 amino acid sequence
WASTRES

SEQ ID NO: 4462 - DNA, 21 bp, Artificial Sequence
  Description of Artificial Sequence: Synthetic Light chain variable region CDR L2 nucleic acid sequence
tgggcatctacccgggaatcc

SEQ ID NO: 4463 - protein, 8 aa, Artificial Sequence
  Description of Artificial Sequence: Synthetic Light chain variable region CDR L3 amino acid sequence
KQSYSRRT

SEQ ID NO: 4464 - DNA, 24 bp, Artificial Sequence
  Description of Artificial Sequence: Synthetic Light chain variable region CDR L3 nucleic acid sequence
aagcaatcttattctcggagaact

SEQ ID NO: 4465 - DNA, 357 bp, Artificial Sequence; identical to SEQ ID NO: 4337
  Description of Artificial Sequence: Synthetic Heavy chain variable region nucleic acid sequence

SEQ ID NO: 4466 - protein, 119 aa, Artificial Sequence; identical to SEQ ID NO: 4338
  Description of Artificial Sequence: Synthetic Heavy chain variable region amino acid sequence

SEQ ID NO: 4467 - protein, 9 aa, Artificial Sequence
  Description of Artificial Sequence: Synthetic Heavy chain variable region CDR H1 amino acid sequence
FNIKDYYMH

SEQ ID NO: 4468 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4469 - protein, 17 aa, Artificial Sequence
  Description of Artificial Sequence: Synthetic Heavy chain variable region CDR H2 amino acid sequence
WIDLEEGNTIYQPKFQG

SEQ ID NO: 4470 - DNA, 51 bp, Artificial Sequence; identical to SEQ ID NO: 4342
  Description of Artificial Sequence: Synthetic Heavy chain variable region CDR H2 nucleic acid sequence

SEQ ID NO: 4471 - protein, 12 aa, Artificial Sequence
  Description of Artificial Sequence: Synthetic Heavy chain variable region CDR H3 amino acid sequence
ARDGYGRYFYDV

SEQ ID NO: 4472 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4473 - DNA, 336 bp, Artificial Sequence; identical to SEQ ID NO: 3865
  Description of Artificial Sequence: Synthetic Light chain variable region nucleic acid sequence

SEQ ID NO: 4474 - protein, 112 aa, Artificial Sequence; identical to SEQ ID NO: 3866
  Description of Artificial Sequence: Synthetic Light chain variable region amino acid sequence

SEQ ID NO: 4475 - protein, 17 aa, Artificial Sequence
  Description of Artificial Sequence: Synthetic Light chain variable region CDR L1 amino acid sequence
KSSQSLLNSRTGKNYLA

SEQ ID NO: 4476 - DNA, 51 bp, Artificial Sequence; identical to SEQ ID NO: 3868
  Description of Artificial Sequence: Synthetic Light chain variable region CDR L1 nucleic acid sequence

SEQ ID NO: 4477 - protein, 7 aa, Artificial Sequence
  Description of Artificial Sequence: Synthetic Light chain variable region CDR L2 amino acid sequence
WASTRES

SEQ ID NO: 4478 - DNA, 21 bp, Artificial Sequence
  Description of Artificial Sequence: Synthetic Light chain variable region CDR L2 nucleic acid sequence
tgggcatctacccgggaatcc

SEQ ID NO: 4479 - protein, 8 aa, Artificial Sequence
  Description of Artificial Sequence: Synthetic Light chain variable region CDR L3 amino acid sequence
KQSYSRRT

SEQ ID NO: 4480 - DNA, 24 bp, Artificial Sequence
  Description of Artificial Sequence: Synthetic Light chain variable region CDR L3 nucleic acid sequence
aagcaatcttattctcggagaact

SEQ ID NO: 4481 - DNA, 357 bp, Artificial Sequence; identical to SEQ ID NO: 4353
  Description of Artificial Sequence: Synthetic Heavy chain variable region nucleic acid sequence

SEQ ID NO: 4482 - protein, 119 aa, Artificial Sequence; identical to SEQ ID NO: 4354
  Description of Artificial Sequence: Synthetic Heavy chain variable region amino acid sequence

SEQ ID NO: 4483 - protein, 9 aa, Artificial Sequence
  Description of Artificial Sequence: Synthetic Heavy chain variable region CDR H1 amino acid sequence
FNIKDYYMH

SEQ ID NO: 4484 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4485 - protein, 17 aa, Artificial Sequence
  Description of Artificial Sequence: Synthetic Heavy chain variable region CDR H2 amino acid sequence
WIDLENGNTIYQPKFQG

SEQ ID NO: 4486 - DNA, 51 bp, Artificial Sequence; identical to SEQ ID NO: 4310
  Description of Artificial Sequence: Synthetic Heavy chain variable region CDR H2 nucleic acid sequence

SEQ ID NO: 4487 - protein, 12 aa, Artificial Sequence
  Description of Artificial Sequence: Synthetic Heavy chain variable region CDR H3 amino acid sequence
AREGYGRYFYDV

SEQ ID NO: 4488 - DNA, 36 bp, Artificial Sequence; identical to SEQ ID NO: 4328
  Description of Artificial Sequence: Synthetic Heavy chain variable region CDR H3 nucleic acid sequence

SEQ ID NO: 4489 - DNA, 336 bp, Artificial Sequence; identical to SEQ ID NO: 3865
  Description of Artificial Sequence: Synthetic Light chain variable region nucleic acid sequence

SEQ ID NO: 4490 - protein, 112 aa, Artificial Sequence; identical to SEQ ID NO: 3866
  Description of Artificial Sequence: Synthetic Light chain variable region amino acid sequence

SEQ ID NO: 4491 - protein, 17 aa, Artificial Sequence
  Description of Artificial Sequence: Synthetic Light chain variable region CDR L1 amino acid sequence
KSSQSLLNSRTGKNYLA

SEQ ID NO: 4492 - DNA, 51 bp, Artificial Sequence; identical to SEQ ID NO: 3868
  Description of Artificial Sequence: Synthetic Light chain variable region CDR L1 nucleic acid sequence

SEQ ID NO: 4493 - protein, 7 aa, Artificial Sequence
  Description of Artificial Sequence: Synthetic Light chain variable region CDR L2 amino acid sequence
WASTRES

SEQ ID NO: 4494 - DNA, 21 bp, Artificial Sequence
  Description of Artificial Sequence: Synthetic Light chain variable region CDR L2 nucleic acid sequence
tgggcatctacccgggaatcc

SEQ ID NO: 4495 - protein, 8 aa, Artificial Sequence
  Description of Artificial Sequence: Synthetic Light chain variable region CDR L3 amino acid sequence
KQSYSRRT

SEQ ID NO: 4496 - DNA, 24 bp, Artificial Sequence
  Description of Artificial Sequence: Synthetic Light chain variable region CDR L3 nucleic acid sequence
aagcaatcttattctcggagaact

SEQ ID NO: 4497 - DNA, 357 bp, Artificial Sequence; identical to SEQ ID NO: 4369
  Description of Artificial Sequence: Synthetic Heavy chain variable region nucleic acid sequence

SEQ ID NO: 4498 - protein, 119 aa, Artificial Sequence; identical to SEQ ID NO: 4370
  Description of Artificial Sequence: Synthetic Heavy chain variable region amino acid sequence

SEQ ID NO: 4499 - protein, 9 aa, Artificial Sequence
  Description of Artificial Sequence: Synthetic Heavy chain variable region CDR H1 amino acid sequence
FNIKDYYMH

SEQ ID NO: 4500 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4501 - protein, 17 aa, Artificial Sequence
  Description of Artificial Sequence: Synthetic Heavy chain variable region CDR H2 amino acid sequence
WIDLEEGNTIYDPKFQG

SEQ ID NO: 4502 - DNA, 51 bp, Artificial Sequence; identical to SEQ ID NO: 4294
  Description of Artificial Sequence: Synthetic Heavy chain variable region CDR H2 nucleic acid sequence

SEQ ID NO: 4503 - protein, 12 aa, Artificial Sequence
  Description of Artificial Sequence: Synthetic Heavy chain variable region CDR H3 amino acid sequence
AREGYGRYFYDV

SEQ ID NO: 4504 - DNA, 36 bp, Artificial Sequence; identical to SEQ ID NO: 4328
  Description of Artificial Sequence: Synthetic Heavy chain variable region CDR H3 nucleic acid sequence

SEQ ID NO: 4505 - DNA, 336 bp, Artificial Sequence; identical to SEQ ID NO: 3865
  Description of Artificial Sequence: Synthetic Light chain variable region nucleic acid sequence

SEQ ID NO: 4506 - protein, 112 aa, Artificial Sequence; identical to SEQ ID NO: 3866
  Description of Artificial Sequence: Synthetic Light chain variable region amino acid sequence

SEQ ID NO: 4507 - protein, 17 aa, Artificial Sequence
  Description of Artificial Sequence: Synthetic Light chain variable region CDR L1 amino acid sequence
KSSQSLLNSRTGKNYLA

SEQ ID NO: 4508 - DNA, 51 bp, Artificial Sequence; identical to SEQ ID NO: 3868
  Description of Artificial Sequence: Synthetic Light chain variable region CDR L1 nucleic acid sequence

SEQ ID NO: 4509 - protein, 7 aa, Artificial Sequence
  Description of Artificial Sequence: Synthetic Light chain variable region CDR L2 amino acid sequence
WASTRES

SEQ ID NO: 4510 - DNA, 21 bp, Artificial Sequence
  Description of Artificial Sequence: Synthetic Light chain variable region CDR L2 nucleic acid sequence
tgggcatctacccgggaatcc

SEQ ID NO: 4511 - protein, 8 aa, Artificial Sequence
  Description of Artificial Sequence: Synthetic Light chain variable region CDR L3 amino acid sequence
KQSYSRRT

SEQ ID NO: 4512 - DNA, 24 bp, Artificial Sequence
  Description of Artificial Sequence: Synthetic Light chain variable region CDR L3 nucleic acid sequence
aagcaatcttattctcggagaact

SEQ ID NO: 4513 - DNA, 357 bp, Artificial Sequence; identical to SEQ ID NO: 4385
  Description of Artificial Sequence: Synthetic Heavy chain variable region nucleic acid sequence

SEQ ID NO: 4514 - protein, 119 aa, Artificial Sequence; identical to SEQ ID NO: 4386
  Description of Artificial Sequence: Synthetic Heavy chain variable region amino acid sequence

SEQ ID NO: 4515 - protein, 9 aa, Artificial Sequence
  Description of Artificial Sequence: Synthetic Heavy chain variable region CDR H1 amino acid sequence
FNIKDYYMH

SEQ ID NO: 4516 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4517 - protein, 17 aa, Artificial Sequence
  Description of Artificial Sequence: Synthetic Heavy chain variable region CDR H2 amino acid sequence
WIDLEEGNTIYQPKFQG

SEQ ID NO: 4518 - DNA, 51 bp, Artificial Sequence; identical to SEQ ID NO: 4342
  Description of Artificial Sequence: Synthetic Heavy chain variable region CDR H2 nucleic acid sequence

SEQ ID NO: 4519 - protein, 12 aa, Artificial Sequence
  Description of Artificial Sequence: Synthetic Heavy chain variable region CDR H3 amino acid sequence
AREGYGRYFYDV

SEQ ID NO: 4520 - DNA, 36 bp, Artificial Sequence; identical to SEQ ID NO: 4328
  Description of Artificial Sequence: Synthetic Heavy chain variable region CDR H3 nucleic acid sequence

SEQ ID NO: 4521 - DNA, 336 bp, Artificial Sequence; identical to SEQ ID NO: 3865
  Description of Artificial Sequence: Synthetic Light chain variable region nucleic acid sequence

SEQ ID NO: 4522 - protein, 112 aa, Artificial Sequence; identical to SEQ ID NO: 3866
  Description of Artificial Sequence: Synthetic Light chain variable region amino acid sequence

SEQ ID NO: 4523 - protein, 17 aa, Artificial Sequence
  Description of Artificial Sequence: Synthetic Light chain variable region CDR L1 amino acid sequence
KSSQSLLNSRTGKNYLA

SEQ ID NO: 4524 - DNA, 51 bp, Artificial Sequence; identical to SEQ ID NO: 3868
  Description of Artificial Sequence: Synthetic Light chain variable region CDR L1 nucleic acid sequence

SEQ ID NO: 4525 - protein, 7 aa, Artificial Sequence
  Description of Artificial Sequence: Synthetic Light chain variable region CDR L2 amino acid sequence
WASTRES

SEQ ID NO: 4526 - DNA, 21 bp, Artificial Sequence
  Description of Artificial Sequence: Synthetic Light chain variable region CDR L2 nucleic acid sequence
tgggcatctacccgggaatcc

SEQ ID NO: 4527 - protein, 8 aa, Artificial Sequence
  Description of Artificial Sequence: Synthetic Light chain variable region CDR L3 amino acid sequence
KQSYSRRT

SEQ ID NO: 4528 - DNA, 24 bp, Artificial Sequence
  Description of Artificial Sequence: Synthetic Light chain variable region CDR L3 nucleic acid sequence
aagcaatcttattctcggagaact

SEQ ID NO: 4529 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacccgaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 4530 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDPKFQGRVTITRDTSASTAYMELSSLRSEDTAVYYCARDGYGRYFYDVWGQGTLVTVSS

SEQ ID NO: 4531 - protein, 9 aa, Artificial Sequence
  Description of Artificial Sequence: Synthetic Heavy chain variable region CDR H1 amino acid sequence
FNIKDYYMH

SEQ ID NO: 4532 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4533 - protein, 17 aa, Artificial Sequence
  Description of Artificial Sequence: Synthetic Heavy chain variable region CDR H2 amino acid sequence
WIDLENANTIYDPKFQG

SEQ ID NO: 4534 - DNA, 51 bp, Artificial Sequence
  Description of Artificial Sequence: Synthetic Heavy chain variable region CDR H2 nucleic acid sequence
tggatcgaccttgaaaatgctaacacaatctatgacccgaagtttcagggc

SEQ ID NO: 4535 - protein, 12 aa, Artificial Sequence
  Description of Artificial Sequence: Synthetic Heavy chain variable region CDR H3 amino acid sequence
ARDGYGRYFYDV

SEQ ID NO: 4536 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4537 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacgctagaaccggaaagaactacttagcttggtaccagcagaaaccaggacagcctcctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctcggagaactttcggcggagggaccaaggtcgagatcaaa

SEQ ID NO: 4538 - protein, 112 aa, Artificial Sequence
  Description of Artificial Sequence: Synthetic Light chain variable region amino acid sequence
DIVMTQSPDSLAVSLGERATINCKSSQSLLNARTGKNYLAWYQQKPGQPPKLLIYWASTRESGVPDRFSGSGSGTDFTLTISSLQAEDVAVYYCKQSYSRRTFGGGTKVEIK

SEQ ID NO: 4539 - protein, 17 aa, Artificial Sequence
  Description of Artificial Sequence: Synthetic Light chain variable region CDR L1 amino acid sequence
KSSQSLLNARTGKNYLA

SEQ ID NO: 4540 - DNA, 51 bp, Artificial Sequence
  Description of Artificial Sequence: Synthetic Light chain variable region CDR L1 nucleic acid sequence
aagtccagccagagtcttttaaacgctagaaccggaaagaactacttagct

SEQ ID NO: 4541 - protein, 7 aa, Artificial Sequence
  Description of Artificial Sequence: Synthetic Light chain variable region CDR L2 amino acid sequence
WASTRES

SEQ ID NO: 4542 - DNA, 21 bp, Artificial Sequence
  Description of Artificial Sequence: Synthetic Light chain variable region CDR L2 nucleic acid sequence
tgggcatctacccgggaatcc

SEQ ID NO: 4543 - protein, 8 aa, Artificial Sequence
  Description of Artificial Sequence: Synthetic Light chain variable region CDR L3 amino acid sequence
KQSYSRRT

SEQ ID NO: 4544 - DNA, 24 bp, Artificial Sequence
  Description of Artificial Sequence: Synthetic Light chain variable region CDR L3 nucleic acid sequence
aagcaatcttattctcggagaact

SEQ ID NO: 4545 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacgctaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 4546 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDAKFQGRVTITRDTSASTAYMELSSLRSEDTAVYYCARDGYGRYFYDVWGQGTLVTVSS

SEQ ID NO: 4547 - protein, 9 aa, Artificial Sequence
  Description of Artificial Sequence: Synthetic Heavy chain variable region CDR H1 amino acid sequence
FNIKDYYMH

SEQ ID NO: 4548 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4549 - protein, 17 aa, Artificial Sequence
  Description of Artificial Sequence: Synthetic Heavy chain variable region CDR H2 amino acid sequence
WIDLENGNTIYDAKFQG

SEQ ID NO: 4550 - DNA, 51 bp, Artificial Sequence
  Description of Artificial Sequence: Synthetic Heavy chain variable region CDR H2 nucleic acid sequence
tggatcgaccttgaaaatggtaacacaatctatgacgctaagtttcagggc

SEQ ID NO: 4551 - protein, 12 aa, Artificial Sequence
  Description of Artificial Sequence: Synthetic Heavy chain variable region CDR H3 amino acid sequence
ARDGYGRYFYDV

SEQ ID NO: 4552 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4553 - DNA, 336 bp, Artificial Sequence; identical to SEQ ID NO: 4537
  Description of Artificial Sequence: Synthetic Light chain variable region nucleic acid sequence

SEQ ID NO: 4554 - protein, 112 aa, Artificial Sequence; identical to SEQ ID NO: 4538
  Description of Artificial Sequence: Synthetic Light chain variable region amino acid sequence

SEQ ID NO: 4555 - protein, 17 aa, Artificial Sequence
  Description of Artificial Sequence: Synthetic Light chain variable region CDR L1 amino acid sequence
KSSQSLLNARTGKNYLA

SEQ ID NO: 4556 - DNA, 51 bp, Artificial Sequence; identical to SEQ ID NO: 4540
  Description of Artificial Sequence: Synthetic Light chain variable region CDR L1 nucleic acid sequence

SEQ ID NO: 4557 - protein, 7 aa, Artificial Sequence
  Description of Artificial Sequence: Synthetic Light chain variable region CDR L2 amino acid sequence
WASTRES

SEQ ID NO: 4558 - DNA, 21 bp, Artificial Sequence
  Description of Artificial Sequence: Synthetic Light chain variable region CDR L2 nucleic acid sequence
tgggcatctacccgggaatcc

SEQ ID NO: 4559 - protein, 8 aa, Artificial Sequence
  Description of Artificial Sequence: Synthetic Light chain variable region CDR L3 amino acid sequence
KQSYSRRT

SEQ ID NO: 4560 - DNA, 24 bp, Artificial Sequence
  Description of Artificial Sequence: Synthetic Light chain variable region CDR L3 nucleic acid sequence
aagcaatcttattctcggagaact

SEQ ID NO: 4561 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatgcttacgggagatatttttacgacgtgtggggccaaggaaccctggtcaccgtctcctca

SEQ ID NO: 4562 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDAYGRYFYDVWGQGTLVTVSS

SEQ ID NO: 4563 - protein, 9 aa, Artificial Sequence
  Description of Artificial Sequence: Synthetic Heavy chain variable region CDR H1 amino acid sequence
FNIKDYYMH

SEQ ID NO: 4564 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4565 - protein, 17 aa, Artificial Sequence
  Description of Artificial Sequence: Synthetic Heavy chain variable region CDR H2 amino acid sequence
WIDLENGNTIYDPKFQG

SEQ ID NO: 4566 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4567 - protein, 12 aa, Artificial Sequence
  Description of Artificial Sequence: Synthetic Heavy chain variable region CDR H3 amino acid sequence
ARDAYGRYFYDV

SEQ ID NO: 4568 - DNA, 36 bp, Artificial Sequence
  Description of Artificial Sequence: Synthetic Heavy chain variable region CDR H3 nucleic acid sequence
gcgagagatgcttacgggagatatttttacgacgtg

SEQ ID NO: 4569 - DNA, 336 bp, Artificial Sequence; identical to SEQ ID NO: 4537
  Description of Artificial Sequence: Synthetic Light chain variable region nucleic acid sequence

SEQ ID NO: 4570 - protein, 112 aa, Artificial Sequence; identical to SEQ ID NO: 4538
  Description of Artificial Sequence: Synthetic Light chain variable region amino acid sequence

SEQ ID NO: 4571 - protein, 17 aa, Artificial Sequence
  Description of Artificial Sequence: Synthetic Light chain variable region CDR L1 amino acid sequence
KSSQSLLNARTGKNYLA

SEQ ID NO: 4572 - DNA, 51 bp, Artificial Sequence; identical to SEQ ID NO: 4540
  Description of Artificial Sequence: Synthetic Light chain variable region CDR L1 nucleic acid sequence

SEQ ID NO: 4573 - protein, 7 aa, Artificial Sequence
  Description of Artificial Sequence: Synthetic Light chain variable region CDR L2 amino acid sequence
WASTRES

SEQ ID NO: 4574 - DNA, 21 bp, Artificial Sequence
  Description of Artificial Sequence: Synthetic Light chain variable region CDR L2 nucleic acid sequence
tgggcatctacccgggaatcc

SEQ ID NO: 4575 - protein, 8 aa, Artificial Sequence
  Description of Artificial Sequence: Synthetic Light chain variable region CDR L3 amino acid sequence
KQSYSRRT

SEQ ID NO: 4576 - DNA, 24 bp, Artificial Sequence
  Description of Artificial Sequence: Synthetic Light chain variable region CDR L3 nucleic acid sequence
aagcaatcttattctcggagaact

SEQ ID NO: 4577 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacgctaagtttcagggcagggtcaccataaccagggacacgtccgccagcacagcctacatggagctgagcagcctgagatctgaagacacggcggtgtactactgcgcgagagatgcttacgggagatatttttacgacgtgtggggccaaggaaccctggtcaccgtctcctca

SEQ ID NO: 4578 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDAKFQGRVTITRDTSASTAYMELSSLRSEDTAVYYCARDAYGRYFYDVWGQGTLVTVSS

SEQ ID NO: 4579 - protein, 9 aa, Artificial Sequence
  Description of Artificial Sequence: Synthetic Heavy chain variable region CDR H1 amino acid sequence
FNIKDYYMH

SEQ ID NO: 4580 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4581 - protein, 17 aa, Artificial Sequence
  Description of Artificial Sequence: Synthetic Heavy chain variable region CDR H2 amino acid sequence
WIDLENGNTIYDAKFQG

SEQ ID NO: 4582 - DNA, 51 bp, Artificial Sequence; identical to SEQ ID NO: 4550
  Description of Artificial Sequence: Synthetic Heavy chain variable region CDR H2 nucleic acid sequence

SEQ ID NO: 4583 - protein, 12 aa, Artificial Sequence
  Description of Artificial Sequence: Synthetic Heavy chain variable region CDR H3 amino acid sequence
ARDAYGRYFYDV

SEQ ID NO: 4584 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 4585 - DNA, 336 bp, Artificial Sequence; identical to SEQ ID NO: 4537
  Description of Artificial Sequence: Synthetic Light chain variable region nucleic acid sequence

SEQ ID NO: 4586 - protein, 112 aa, Artificial Sequence; identical to SEQ ID NO: 4538
  Description of Artificial Sequence: Synthetic Light chain variable region amino acid sequence

SEQ ID NO: 4587 - protein, 17 aa, Artificial Sequence
  Description of Artificial Sequence: Synthetic Light chain variable region CDR L1 amino acid sequence
KSSQSLLNARTGKNYLA

SEQ ID NO: 4588 - DNA, 51 bp, Artificial Sequence; identical to SEQ ID NO: 4540
  Description of Artificial Sequence: Synthetic Light chain variable region CDR L1 nucleic acid sequence

SEQ ID NO: 4589 - protein, 7 aa, Artificial Sequence
  Description of Artificial Sequence: Synthetic Light chain variable region CDR L2 amino acid sequence
WASTRES

SEQ ID NO: 4590 - DNA, 21 bp, Artificial Sequence
  Description of Artificial Sequence: Synthetic Light chain variable region CDR L2 nucleic acid sequence
tgggcatctacccgggaatcc

SEQ ID NO: 4591 - protein, 8 aa, Artificial Sequence
  Description of Artificial Sequence: Synthetic Light chain variable region CDR L3 amino acid sequence
KQSYSRRT

SEQ ID NO: 4592 - DNA, 24 bp, Artificial Sequence
  Description of Artificial Sequence: Synthetic Light chain variable region CDR L3 nucleic acid sequence
aagcaatcttattctcggagaact

SEQ ID NO: 4593 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacccgaagtttcagggcagggtcaccataaccagggacacgtccgccagcacagcctacatggagctgagcagcctgagatctgaagacacggcggtgtactactgcgcgagagatgcttacgggagatatttttacgacgtgtggggccaaggaaccctggtcaccgtctcctca

SEQ ID NO: 4594 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDPKFQGRVTITRDTSASTAYMELSSLRSEDTAVYYCARDAYGRYFYDVWGQGTLVTVSS

SEQ ID NO: 4595 - protein, 9 aa, Artificial Sequence
  Description of Artificial Sequence: Synthetic Heavy chain variable region CDR H1 amino acid sequence
FNIKDYYMH

SEQ ID NO: 4596 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4597 - protein, 17 aa, Artificial Sequence
  Description of Artificial Sequence: Synthetic Heavy chain variable region CDR H2 amino acid sequence
WIDLENANTIYDPKFQG

SEQ ID NO: 4598 - DNA, 51 bp, Artificial Sequence; identical to SEQ ID NO: 4534
  Description of Artificial Sequence: Synthetic Heavy chain variable region CDR H2 nucleic acid sequence

SEQ ID NO: 4599 - protein, 12 aa, Artificial Sequence
  Description of Artificial Sequence: Synthetic Heavy chain variable region CDR H3 amino acid sequence
ARDAYGRYFYDV

SEQ ID NO: 4600 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 4601 - DNA, 336 bp, Artificial Sequence; identical to SEQ ID NO: 4537
  Description of Artificial Sequence: Synthetic Light chain variable region nucleic acid sequence

SEQ ID NO: 4602 - protein, 112 aa, Artificial Sequence; identical to SEQ ID NO: 4538
  Description of Artificial Sequence: Synthetic Light chain variable region amino acid sequence

SEQ ID NO: 4603 - protein, 17 aa, Artificial Sequence
  Description of Artificial Sequence: Synthetic Light chain variable region CDR L1 amino acid sequence
KSSQSLLNARTGKNYLA

SEQ ID NO: 4604 - DNA, 51 bp, Artificial Sequence; identical to SEQ ID NO: 4540
  Description of Artificial Sequence: Synthetic Light chain variable region CDR L1 nucleic acid sequence

SEQ ID NO: 4605 - protein, 7 aa, Artificial Sequence
  Description of Artificial Sequence: Synthetic Light chain variable region CDR L2 amino acid sequence
WASTRES

SEQ ID NO: 4606 - DNA, 21 bp, Artificial Sequence
  Description of Artificial Sequence: Synthetic Light chain variable region CDR L2 nucleic acid sequence
tgggcatctacccgggaatcc

SEQ ID NO: 4607 - protein, 8 aa, Artificial Sequence
  Description of Artificial Sequence: Synthetic Light chain variable region CDR L3 amino acid sequence
KQSYSRRT

SEQ ID NO: 4608 - DNA, 24 bp, Artificial Sequence
  Description of Artificial Sequence: Synthetic Light chain variable region CDR L3 nucleic acid sequence
aagcaatcttattctcggagaact

SEQ ID NO: 4609 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcctctggattcaacatcaaggactactatatgcactgggtgcgacaggctcctggacaaaggcttgagtggatgggatggatcgaccttgaaaatgctaacacaatctatgacccgaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 4610 - protein, 119 aa, Artificial Sequence; identical to SEQ ID NO: 4530
  Description of Artificial Sequence: Synthetic Heavy chain variable region amino acid sequence

SEQ ID NO: 4611 - protein, 9 aa, Artificial Sequence
  Description of Artificial Sequence: Synthetic Heavy chain variable region CDR H1 amino acid sequence
FNIKDYYMH

SEQ ID NO: 4612 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4613 - protein, 17 aa, Artificial Sequence
  Description of Artificial Sequence: Synthetic Heavy chain variable region CDR H2 amino acid sequence
WIDLENANTIYDPKFQG

SEQ ID NO: 4614 - DNA, 51 bp, Artificial Sequence; identical to SEQ ID NO: 4534
  Description of Artificial Sequence: Synthetic Heavy chain variable region CDR H2 nucleic acid sequence

SEQ ID NO: 4615 - protein, 12 aa, Artificial Sequence
  Description of Artificial Sequence: Synthetic Heavy chain variable region CDR H3 amino acid sequence
ARDGYGRYFYDV

SEQ ID NO: 4616 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4617 - DNA, 336 bp, Artificial Sequence; identical to SEQ ID NO: 3865
  Description of Artificial Sequence: Synthetic Light chain variable region nucleic acid sequence

SEQ ID NO: 4618 - protein, 112 aa, Artificial Sequence; identical to SEQ ID NO: 3866
  Description of Artificial Sequence: Synthetic Light chain variable region amino acid sequence

SEQ ID NO: 4619 - protein, 17 aa, Artificial Sequence
  Description of Artificial Sequence: Synthetic Light chain variable region CDR L1 amino acid sequence
KSSQSLLNSRTGKNYLA

SEQ ID NO: 4620 - DNA, 51 bp, Artificial Sequence; identical to SEQ ID NO: 3868
  Description of Artificial Sequence: Synthetic Light chain variable region CDR L1 nucleic acid sequence

SEQ ID NO: 4621 - protein, 7 aa, Artificial Sequence
  Description of Artificial Sequence: Synthetic Light chain variable region CDR L2 amino acid sequence
WASTRES

SEQ ID NO: 4622 - DNA, 21 bp, Artificial Sequence
  Description of Artificial Sequence: Synthetic Light chain variable region CDR L2 nucleic acid sequence
tgggcatctacccgggaatcc

SEQ ID NO: 4623 - protein, 8 aa, Artificial Sequence
  Description of Artificial Sequence: Synthetic Light chain variable region CDR L3 amino acid sequence
KQSYSRRT

SEQ ID NO: 4624 - DNA, 24 bp, Artificial Sequence
  Description of Artificial Sequence: Synthetic Light chain variable region CDR L3 nucleic acid sequence
aagcaatcttattctcggagaact

SEQ ID NO: 4625 - DNA, 357 bp, Artificial Sequence; identical to SEQ ID NO: 4545
  Description of Artificial Sequence: Synthetic Heavy chain variable region nucleic acid sequence

SEQ ID NO: 4626 - protein, 119 aa, Artificial Sequence; identical to SEQ ID NO: 4546
  Description of Artificial Sequence: Synthetic Heavy chain variable region amino acid sequence

SEQ ID NO: 4627 - protein, 9 aa, Artificial Sequence
  Description of Artificial Sequence: Synthetic Heavy chain variable region CDR H1 amino acid sequence
FNIKDYYMH

SEQ ID NO: 4628 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4629 - protein, 17 aa, Artificial Sequence
  Description of Artificial Sequence: Synthetic Heavy chain variable region CDR H2 amino acid sequence
WIDLENGNTIYDAKFQG

SEQ ID NO: 4630 - DNA, 51 bp, Artificial Sequence; identical to SEQ ID NO: 4550
  Description of Artificial Sequence: Synthetic Heavy chain variable region CDR H2 nucleic acid sequence

SEQ ID NO: 4631 - protein, 12 aa, Artificial Sequence
  Description of Artificial Sequence: Synthetic Heavy chain variable region CDR H3 amino acid sequence
ARDGYGRYFYDV

SEQ ID NO: 4632 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4633 - DNA, 336 bp, Artificial Sequence; identical to SEQ ID NO: 3865
  Description of Artificial Sequence: Synthetic Light chain variable region nucleic acid sequence

SEQ ID NO: 4634 - protein, 112 aa, Artificial Sequence; identical to SEQ ID NO: 3866
  Description of Artificial Sequence: Synthetic Light chain variable region amino acid sequence

SEQ ID NO: 4635 - protein, 17 aa, Artificial Sequence
  Description of Artificial Sequence: Synthetic Light chain variable region CDR L1 amino acid sequence
KSSQSLLNSRTGKNYLA

SEQ ID NO: 4636 - DNA, 51 bp, Artificial Sequence; identical to SEQ ID NO: 3868
  Description of Artificial Sequence: Synthetic Light chain variable region CDR L1 nucleic acid sequence

SEQ ID NO: 4637 - protein, 7 aa, Artificial Sequence
  Description of Artificial Sequence: Synthetic Light chain variable region CDR L2 amino acid sequence
WASTRES

SEQ ID NO: 4638 - DNA, 21 bp, Artificial Sequence
  Description of Artificial Sequence: Synthetic Light chain variable region CDR L2 nucleic acid sequence
tgggcatctacccgggaatcc

SEQ ID NO: 4639 - protein, 8 aa, Artificial Sequence
  Description of Artificial Sequence: Synthetic Light chain variable region CDR L3 amino acid sequence
KQSYSRRT

SEQ ID NO: 4640 - DNA, 24 bp, Artificial Sequence
  Description of Artificial Sequence: Synthetic Light chain variable region CDR L3 nucleic acid sequence
aagcaatcttattctcggagaact

SEQ ID NO: 4641 - DNA, 357 bp, Artificial Sequence; identical to SEQ ID NO: 4561
  Description of Artificial Sequence: Synthetic Heavy chain variable region nucleic acid sequence

SEQ ID NO: 4642 - protein, 119 aa, Artificial Sequence; identical to SEQ ID NO: 4562
  Description of Artificial Sequence: Synthetic Heavy chain variable region amino acid sequence

SEQ ID NO: 4643 - protein, 9 aa, Artificial Sequence
  Description of Artificial Sequence: Synthetic Heavy chain variable region CDR H1 amino acid sequence
FNIKDYYMH

SEQ ID NO: 4644 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4645 - protein, 17 aa, Artificial Sequence
  Description of Artificial Sequence: Synthetic Heavy chain variable region CDR H2 amino acid sequence
WIDLENGNTIYDPKFQG

SEQ ID NO: 4646 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4647 - protein, 12 aa, Artificial Sequence
  Description of Artificial Sequence: Synthetic Heavy chain variable region CDR H3 amino acid sequence
ARDAYGRYFYDV

SEQ ID NO: 4648 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 4649 - DNA, 336 bp, Artificial Sequence; identical to SEQ ID NO: 3865
  Description of Artificial Sequence: Synthetic Light chain variable region nucleic acid sequence

SEQ ID NO: 4650 - protein, 112 aa, Artificial Sequence; identical to SEQ ID NO: 3866
  Description of Artificial Sequence: Synthetic Light chain variable region amino acid sequence

SEQ ID NO: 4651 - protein, 17 aa, Artificial Sequence
  Description of Artificial Sequence: Synthetic Light chain variable region CDR L1 amino acid sequence
KSSQSLLNSRTGKNYLA

SEQ ID NO: 4652 - DNA, 51 bp, Artificial Sequence; identical to SEQ ID NO: 3868
  Description of Artificial Sequence: Synthetic Light chain variable region CDR L1 nucleic acid sequence

SEQ ID NO: 4653 - protein, 7 aa, Artificial Sequence
  Description of Artificial Sequence: Synthetic Light chain variable region CDR L2 amino acid sequence
WASTRES

SEQ ID NO: 4654 - DNA, 21 bp, Artificial Sequence
  Description of Artificial Sequence: Synthetic Light chain variable region CDR L2 nucleic acid sequence
tgggcatctacccgggaatcc

SEQ ID NO: 4655 - protein, 8 aa, Artificial Sequence
  Description of Artificial Sequence: Synthetic Light chain variable region CDR L3 amino acid sequence
KQSYSRRT

SEQ ID NO: 4656 - DNA, 24 bp, Artificial Sequence
  Description of Artificial Sequence: Synthetic Light chain variable region CDR L3 nucleic acid sequence
aagcaatcttattctcggagaact

SEQ ID NO: 4657 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 4658 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDGYGRYFYDVWGQGTLVTVSS

SEQ ID NO: 4659 - protein, 9 aa, Artificial Sequence
  Description of Artificial Sequence: Synthetic Heavy chain variable region CDR H1 amino acid sequence
FNIKDYYMH

SEQ ID NO: 4660 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4661 - protein, 17 aa, Artificial Sequence
  Description of Artificial Sequence: Synthetic Heavy chain variable region CDR H2 amino acid sequence
WIDLENANTIYDAKFQG

SEQ ID NO: 4662 - DNA, 51 bp, Artificial Sequence
  Description of Artificial Sequence: Synthetic Heavy chain variable region CDR H2 nucleic acid sequence
tggatcgaccttgaaaatgctaacacaatctatgacgctaagtttcagggc

SEQ ID NO: 4663 - protein, 12 aa, Artificial Sequence
  Description of Artificial Sequence: Synthetic Heavy chain variable region CDR H3 amino acid sequence
ARDGYGRYFYDV

SEQ ID NO: 4664 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4665 - DNA, 336 bp, Artificial Sequence; identical to SEQ ID NO: 3865
  Description of Artificial Sequence: Synthetic Light chain variable region nucleic acid sequence

SEQ ID NO: 4666 - protein, 112 aa, Artificial Sequence; identical to SEQ ID NO: 3866
  Description of Artificial Sequence: Synthetic Light chain variable region amino acid sequence

SEQ ID NO: 4667 - protein, 17 aa, Artificial Sequence
  Description of Artificial Sequence: Synthetic Light chain variable region CDR L1 amino acid sequence
KSSQSLLNSRTGKNYLA

SEQ ID NO: 4668 - DNA, 51 bp, Artificial Sequence; identical to SEQ ID NO: 3868
  Description of Artificial Sequence: Synthetic Light chain variable region CDR L1 nucleic acid sequence

SEQ ID NO: 4669 - protein, 7 aa, Artificial Sequence
  Description of Artificial Sequence: Synthetic Light chain variable region CDR L2 amino acid sequence
WASTRES

SEQ ID NO: 4670 - DNA, 21 bp, Artificial Sequence
  Description of Artificial Sequence: Synthetic Light chain variable region CDR L2 nucleic acid sequence
tgggcatctacccgggaatcc

SEQ ID NO: 4671 - protein, 8 aa, Artificial Sequence
  Description of Artificial Sequence: Synthetic Light chain variable region CDR L3 amino acid sequence
KQSYSRRT

SEQ ID NO: 4672 - DNA, 24 bp, Artificial Sequence
  Description of Artificial Sequence: Synthetic Light chain variable region CDR L3 nucleic acid sequence
aagcaatcttattctcggagaact

SEQ ID NO: 4673 - DNA, 357 bp, Artificial Sequence; identical to SEQ ID NO: 4577
  Description of Artificial Sequence: Synthetic Heavy chain variable region nucleic acid sequence

SEQ ID NO: 4674 - protein, 119 aa, Artificial Sequence; identical to SEQ ID NO: 4578
  Description of Artificial Sequence: Synthetic Heavy chain variable region amino acid sequence

SEQ ID NO: 4675 - protein, 9 aa, Artificial Sequence
  Description of Artificial Sequence: Synthetic Heavy chain variable region CDR H1 amino acid sequence
FNIKDYYMH

SEQ ID NO: 4676 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4677 - protein, 17 aa, Artificial Sequence
  Description of Artificial Sequence: Synthetic Heavy chain variable region CDR H2 amino acid sequence
WIDLENGNTIYDAKFQG

SEQ ID NO: 4678 - DNA, 51 bp, Artificial Sequence; identical to SEQ ID NO: 4550
  Description of Artificial Sequence: Synthetic Heavy chain variable region CDR H2 nucleic acid sequence

SEQ ID NO: 4679 - protein, 12 aa, Artificial Sequence
  Description of Artificial Sequence: Synthetic Heavy chain variable region CDR H3 amino acid sequence
ARDAYGRYFYDV

SEQ ID NO: 4680 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 4681 - DNA, 336 bp, Artificial Sequence; identical to SEQ ID NO: 3865
  Description of Artificial Sequence: Synthetic Light chain variable region nucleic acid sequence

SEQ ID NO: 4682 - protein, 112 aa, Artificial Sequence; identical to SEQ ID NO: 3866
  Description of Artificial Sequence: Synthetic Light chain variable region amino acid sequence

SEQ ID NO: 4683 - protein, 17 aa, Artificial Sequence
  Description of Artificial Sequence: Synthetic Light chain variable region CDR L1 amino acid sequence
KSSQSLLNSRTGKNYLA

SEQ ID NO: 4684 - DNA, 51 bp, Artificial Sequence; identical to SEQ ID NO: 3868
  Description of Artificial Sequence: Synthetic Light chain variable region CDR L1 nucleic acid sequence

SEQ ID NO: 4685 - protein, 7 aa, Artificial Sequence
  Description of Artificial Sequence: Synthetic Light chain variable region CDR L2 amino acid sequence
WASTRES

SEQ ID NO: 4686 - DNA, 21 bp, Artificial Sequence
  Description of Artificial Sequence: Synthetic Light chain variable region CDR L2 nucleic acid sequence
tgggcatctacccgggaatcc

SEQ ID NO: 4687 - protein, 8 aa, Artificial Sequence
  Description of Artificial Sequence: Synthetic Light chain variable region CDR L3 amino acid sequence
KQSYSRRT

SEQ ID NO: 4688 - DNA, 24 bp, Artificial Sequence
  Description of Artificial Sequence: Synthetic Light chain variable region CDR L3 nucleic acid sequence
aagcaatcttattctcggagaact

SEQ ID NO: 4689 - DNA, 357 bp, Artificial Sequence; identical to SEQ ID NO: 4593
  Description of Artificial Sequence: Synthetic Heavy chain variable region nucleic acid sequence

SEQ ID NO: 4690 - protein, 119 aa, Artificial Sequence; identical to SEQ ID NO: 4594
  Description of Artificial Sequence: Synthetic Heavy chain variable region amino acid sequence

SEQ ID NO: 4691 - protein, 9 aa, Artificial Sequence
  Description of Artificial Sequence: Synthetic Heavy chain variable region CDR H1 amino acid sequence
FNIKDYYMH

SEQ ID NO: 4692 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4693 - protein, 17 aa, Artificial Sequence
  Description of Artificial Sequence: Synthetic Heavy chain variable region CDR H2 amino acid sequence
WIDLENANTIYDPKFQG

SEQ ID NO: 4694 - DNA, 51 bp, Artificial Sequence; identical to SEQ ID NO: 4534
  Description of Artificial Sequence: Synthetic Heavy chain variable region CDR H2 nucleic acid sequence

SEQ ID NO: 4695 - protein, 12 aa, Artificial Sequence
  Description of Artificial Sequence: Synthetic Heavy chain variable region CDR H3 amino acid sequence
ARDAYGRYFYDV

SEQ ID NO: 4696 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 4697 - DNA, 336 bp, Artificial Sequence; identical to SEQ ID NO: 3865
  Description of Artificial Sequence: Synthetic Light chain variable region nucleic acid sequence

SEQ ID NO: 4698 - protein, 112 aa, Artificial Sequence; identical to SEQ ID NO: 3866
  Description of Artificial Sequence: Synthetic Light chain variable region amino acid sequence

SEQ ID NO: 4699 - protein, 17 aa, Artificial Sequence
  Description of Artificial Sequence: Synthetic Light chain variable region CDR L1 amino acid sequence
KSSQSLLNSRTGKNYLA

SEQ ID NO: 4700 - DNA, 51 bp, Artificial Sequence; identical to SEQ ID NO: 3868
  Description of Artificial Sequence: Synthetic Light chain variable region CDR L1 nucleic acid sequence

SEQ ID NO: 4701 - protein, 7 aa, Artificial Sequence
  Description of Artificial Sequence: Synthetic Light chain variable region CDR L2 amino acid sequence
WASTRES

SEQ ID NO: 4702 - DNA, 21 bp, Artificial Sequence
  Description of Artificial Sequence: Synthetic Light chain variable region CDR L2 nucleic acid sequence
tgggcatctacccgggaatcc

SEQ ID NO: 4703 - protein, 8 aa, Artificial Sequence
  Description of Artificial Sequence: Synthetic Light chain variable region CDR L3 amino acid sequence
KQSYSRRT

SEQ ID NO: 4704 - DNA, 24 bp, Artificial Sequence
  Description of Artificial Sequence: Synthetic Light chain variable region CDR L3 nucleic acid sequence
aagcaatcttattctcggagaact

SEQ ID NO: 4705 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatgcttacgggagatatttttacgacgtgtggggccaaggaaccctggtcaccgtctcctca

SEQ ID NO: 4706 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDAYGRYFYDVWGQGTLVTVSS

SEQ ID NO: 4707 - protein, 9 aa, Artificial Sequence
  Description of Artificial Sequence: Synthetic Heavy chain variable region CDR H1 amino acid sequence
FNIKDYYMH

SEQ ID NO: 4708 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4709 - protein, 17 aa, Artificial Sequence
  Description of Artificial Sequence: Synthetic Heavy chain variable region CDR H2 amino acid sequence
WIDLENANTIYDAKFQG

SEQ ID NO: 4710 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 4711 - protein, 12 aa, Artificial Sequence
  Description of Artificial Sequence: Synthetic Heavy chain variable region CDR H3 amino acid sequence
ARDAYGRYFYDV

SEQ ID NO: 4712 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 4713 - DNA, 336 bp, Artificial Sequence; identical to SEQ ID NO: 3865
  Description of Artificial Sequence: Synthetic Light chain variable region nucleic acid sequence

SEQ ID NO: 4714 - protein, 112 aa, Artificial Sequence; identical to SEQ ID NO: 3866
  Description of Artificial Sequence: Synthetic Light chain variable region amino acid sequence

SEQ ID NO: 4715 - protein, 17 aa, Artificial Sequence
  Description of Artificial Sequence: Synthetic Light chain variable region CDR L1 amino acid sequence
KSSQSLLNSRTGKNYLA

SEQ ID NO: 4716 - DNA, 51 bp, Artificial Sequence; identical to SEQ ID NO: 3868
  Description of Artificial Sequence: Synthetic Light chain variable region CDR L1 nucleic acid sequence

SEQ ID NO: 4717 - protein, 7 aa, Artificial Sequence
  Description of Artificial Sequence: Synthetic Light chain variable region CDR L2 amino acid sequence
WASTRES

SEQ ID NO: 4718 - DNA, 21 bp, Artificial Sequence
  Description of Artificial Sequence: Synthetic Light chain variable region CDR L2 nucleic acid sequence
tgggcatctacccgggaatcc

SEQ ID NO: 4719 - protein, 8 aa, Artificial Sequence
  Description of Artificial Sequence: Synthetic Light chain variable region CDR L3 amino acid sequence
KQSYSRRT

SEQ ID NO: 4720 - DNA, 24 bp, Artificial Sequence
  Description of Artificial Sequence: Synthetic Light chain variable region CDR L3 nucleic acid sequence
aagcaatcttattctcggagaact

SEQ ID NO: 4721 - DNA, 357 bp, Artificial Sequence; identical to SEQ ID NO: 4161
  Description of Artificial Sequence: Synthetic Heavy chain variable region nucleic acid sequence

SEQ ID NO: 4722 - protein, 119 aa, Artificial Sequence; identical to SEQ ID NO: 4162
  Description of Artificial Sequence: Synthetic Heavy chain variable region amino acid sequence

SEQ ID NO: 4723 - protein, 9 aa, Artificial Sequence
  Description of Artificial Sequence: Synthetic Heavy chain variable region CDR H1 amino acid sequence
FNIKDYYMH

SEQ ID NO: 4724 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4725 - protein, 17 aa, Artificial Sequence
  Description of Artificial Sequence: Synthetic Heavy chain variable region CDR H2 amino acid sequence
WIDLENGNTIYDPKFQG

SEQ ID NO: 4726 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4727 - protein, 12 aa, Artificial Sequence
  Description of Artificial Sequence: Synthetic Heavy chain variable region CDR H3 amino acid sequence
ARDGYGRYFYDV

SEQ ID NO: 4728 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4729 - DNA, 336 bp, Artificial Sequence; identical to SEQ ID NO: 3865
  Description of Artificial Sequence: Synthetic Light chain variable region nucleic acid sequence

SEQ ID NO: 4730 - protein, 112 aa, Artificial Sequence; identical to SEQ ID NO: 3866
  Description of Artificial Sequence: Synthetic Light chain variable region amino acid sequence

SEQ ID NO: 4731 - protein, 17 aa, Artificial Sequence
  Description of Artificial Sequence: Synthetic Light chain variable region CDR L1 amino acid sequence
KSSQSLLNSRTGKNYLA

SEQ ID NO: 4732 - DNA, 51 bp, Artificial Sequence; identical to SEQ ID NO: 3868
  Description of Artificial Sequence: Synthetic Light chain variable region CDR L1 nucleic acid sequence

SEQ ID NO: 4733 - protein, 7 aa, Artificial Sequence
  Description of Artificial Sequence: Synthetic Light chain variable region CDR L2 amino acid sequence
WASTRES

SEQ ID NO: 4734 - DNA, 21 bp, Artificial Sequence
  Description of Artificial Sequence: Synthetic Light chain variable region CDR L2 nucleic acid sequence
tgggcatctacccgggaatcc

SEQ ID NO: 4735 - protein, 8 aa, Artificial Sequence
  Description of Artificial Sequence: Synthetic Light chain variable region CDR L3 amino acid sequence
KQSYSRRT

SEQ ID NO: 4736 - DNA, 24 bp, Artificial Sequence
  Description of Artificial Sequence: Synthetic Light chain variable region CDR L3 nucleic acid sequence
aagcaatcttattctcggagaact

SEQ ID NO: 4737 - DNA, 357 bp, Artificial Sequence; identical to SEQ ID NO: 4161
  Description of Artificial Sequence: Synthetic Heavy chain variable region nucleic acid sequence

SEQ ID NO: 4738 - protein, 119 aa, Artificial Sequence; identical to SEQ ID NO: 4162
  Description of Artificial Sequence: Synthetic Heavy chain variable region amino acid sequence

SEQ ID NO: 4739 - protein, 9 aa, Artificial Sequence
  Description of Artificial Sequence: Synthetic Heavy chain variable region CDR H1 amino acid sequence
FNIKDYYMH

SEQ ID NO: 4740 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4741 - protein, 17 aa, Artificial Sequence
  Description of Artificial Sequence: Synthetic Heavy chain variable region CDR H2 amino acid sequence
WIDLENGNTIYDPKFQG

SEQ ID NO: 4742 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4743 - protein, 12 aa, Artificial Sequence
  Description of Artificial Sequence: Synthetic Heavy chain variable region CDR H3 amino acid sequence
ARDGYGRYFYDV

SEQ ID NO: 4744 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4745 - DNA, 336 bp, Artificial Sequence; identical to SEQ ID NO: 3865
  Description of Artificial Sequence: Synthetic Light chain variable region nucleic acid sequence

SEQ ID NO: 4746 - protein, 112 aa, Artificial Sequence; identical to SEQ ID NO: 3866
  Description of Artificial Sequence: Synthetic Light chain variable region amino acid sequence

SEQ ID NO: 4747 - protein, 17 aa, Artificial Sequence
  Description of Artificial Sequence: Synthetic Light chain variable region CDR L1 amino acid sequence
KSSQSLLNSRTGKNYLA

SEQ ID NO: 4748 - DNA, 51 bp, Artificial Sequence; identical to SEQ ID NO: 3868
  Description of Artificial Sequence: Synthetic Light chain variable region CDR L1 nucleic acid sequence

SEQ ID NO: 4749 - protein, 7 aa, Artificial Sequence
  Description of Artificial Sequence: Synthetic Light chain variable region CDR L2 amino acid sequence
WASTRES

SEQ ID NO: 4750 - DNA, 21 bp, Artificial Sequence
  Description of Artificial Sequence: Synthetic Light chain variable region CDR L2 nucleic acid sequence
tgggcatctacccgggaatcc

SEQ ID NO: 4751 - protein, 8 aa, Artificial Sequence
  Description of Artificial Sequence: Synthetic Light chain variable region CDR L3 amino acid sequence
KQSYSRRT

SEQ ID NO: 4752 - DNA, 24 bp, Artificial Sequence
  Description of Artificial Sequence: Synthetic Light chain variable region CDR L3 nucleic acid sequence
aagcaatcttattctcggagaact

SEQ ID NO: 4753 - DNA, 357 bp, Artificial Sequence; identical to SEQ ID NO: 4161
  Description of Artificial Sequence: Synthetic Heavy chain variable region nucleic acid sequence

SEQ ID NO: 4754 - protein, 119 aa, Artificial Sequence; identical to SEQ ID NO: 4162
  Description of Artificial Sequence: Synthetic Heavy chain variable region amino acid sequence

SEQ ID NO: 4755 - protein, 9 aa, Artificial Sequence
  Description of Artificial Sequence: Synthetic Heavy chain variable region CDR H1 amino acid sequence
FNIKDYYMH

SEQ ID NO: 4756 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4757 - protein, 17 aa, Artificial Sequence
  Description of Artificial Sequence: Synthetic Heavy chain variable region CDR H2 amino acid sequence
WIDLENGNTIYDPKFQG

SEQ ID NO: 4758 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4759 - protein, 12 aa, Artificial Sequence
  Description of Artificial Sequence: Synthetic Heavy chain variable region CDR H3 amino acid sequence
ARDGYGRYFYDV

SEQ ID NO: 4760 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4761 - DNA, 336 bp, Artificial Sequence; identical to SEQ ID NO: 3865
  Description of Artificial Sequence: Synthetic Light chain variable region nucleic acid sequence

SEQ ID NO: 4762 - protein, 112 aa, Artificial Sequence; identical to SEQ ID NO: 3866
  Description of Artificial Sequence: Synthetic Light chain variable region amino acid sequence

SEQ ID NO: 4763 - protein, 17 aa, Artificial Sequence
  Description of Artificial Sequence: Synthetic Light chain variable region CDR L1 amino acid sequence
KSSQSLLNSRTGKNYLA

SEQ ID NO: 4764 - DNA, 51 bp, Artificial Sequence; identical to SEQ ID NO: 3868
  Description of Artificial Sequence: Synthetic Light chain variable region CDR L1 nucleic acid sequence

SEQ ID NO: 4765 - protein, 7 aa, Artificial Sequence
  Description of Artificial Sequence: Synthetic Light chain variable region CDR L2 amino acid sequence
WASTRES

SEQ ID NO: 4766 - DNA, 21 bp, Artificial Sequence
  Description of Artificial Sequence: Synthetic Light chain variable region CDR L2 nucleic acid sequence
tgggcatctacccgggaatcc

SEQ ID NO: 4767 - protein, 8 aa, Artificial Sequence
  Description of Artificial Sequence: Synthetic Light chain variable region CDR L3 amino acid sequence
KQSYSRRT

SEQ ID NO: 4768 - DNA, 24 bp, Artificial Sequence
  Description of Artificial Sequence: Synthetic Light chain variable region CDR L3 nucleic acid sequence
aagcaatcttattctcggagaact

SEQ ID NO: 4769 - DNA, 357 bp, Artificial Sequence; identical to SEQ ID NO: 4161
  Description of Artificial Sequence: Synthetic Heavy chain variable region nucleic acid sequence

SEQ ID NO: 4770 - protein, 119 aa, Artificial Sequence; identical to SEQ ID NO: 4162
  Description of Artificial Sequence: Synthetic Heavy chain variable region amino acid sequence

SEQ ID NO: 4771 - protein, 9 aa, Artificial Sequence
  Description of Artificial Sequence: Synthetic Heavy chain variable region CDR H1 amino acid sequence
FNIKDYYMH

SEQ ID NO: 4772 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4773 - protein, 17 aa, Artificial Sequence
  Description of Artificial Sequence: Synthetic Heavy chain variable region CDR H2 amino acid sequence
WIDLENGNTIYDPKFQG

SEQ ID NO: 4774 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4775 - protein, 12 aa, Artificial Sequence
  Description of Artificial Sequence: Synthetic Heavy chain variable region CDR H3 amino acid sequence
ARDGYGRYFYDV

SEQ ID NO: 4776 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4777 - DNA, 336 bp, Artificial Sequence; identical to SEQ ID NO: 3865
  Description of Artificial Sequence: Synthetic Light chain variable region nucleic acid sequence

SEQ ID NO: 4778 - protein, 112 aa, Artificial Sequence; identical to SEQ ID NO: 3866
  Description of Artificial Sequence: Synthetic Light chain variable region amino acid sequence

SEQ ID NO: 4779 - protein, 17 aa, Artificial Sequence
  Description of Artificial Sequence: Synthetic Light chain variable region CDR L1 amino acid sequence
KSSQSLLNSRTGKNYLA

SEQ ID NO: 4780 - DNA, 51 bp, Artificial Sequence; identical to SEQ ID NO: 3868
  Description of Artificial Sequence: Synthetic Light chain variable region CDR L1 nucleic acid sequence

SEQ ID NO: 4781 - protein, 7 aa, Artificial Sequence
  Description of Artificial Sequence: Synthetic Light chain variable region CDR L2 amino acid sequence
WASTRES

SEQ ID NO: 4782 - DNA, 21 bp, Artificial Sequence
  Description of Artificial Sequence: Synthetic Light chain variable region CDR L2 nucleic acid sequence
tgggcatctacccgggaatcc

SEQ ID NO: 4783 - protein, 8 aa, Artificial Sequence
  Description of Artificial Sequence: Synthetic Light chain variable region CDR L3 amino acid sequence
KQSYSRRT

SEQ ID NO: 4784 - DNA, 24 bp, Artificial Sequence
  Description of Artificial Sequence: Synthetic Light chain variable region CDR L3 nucleic acid sequence
aagcaatcttattctcggagaact

SEQ ID NO: 4785 - DNA, 357 bp, Artificial Sequence; identical to SEQ ID NO: 4161
  Description of Artificial Sequence: Synthetic Heavy chain variable region nucleic acid sequence

SEQ ID NO: 4786 - protein, 119 aa, Artificial Sequence; identical to SEQ ID NO: 4162
  Description of Artificial Sequence: Synthetic Heavy chain variable region amino acid sequence

SEQ ID NO: 4787 - protein, 9 aa, Artificial Sequence
  Description of Artificial Sequence: Synthetic Heavy chain variable region CDR H1 amino acid sequence
FNIKDYYMH

SEQ ID NO: 4788 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4789 - protein, 17 aa, Artificial Sequence
  Description of Artificial Sequence: Synthetic Heavy chain variable region CDR H2 amino acid sequence
WIDLENGNTIYDPKFQG

SEQ ID NO: 4790 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4791 - protein, 12 aa, Artificial Sequence
  Description of Artificial Sequence: Synthetic Heavy chain variable region CDR H3 amino acid sequence
ARDGYGRYFYDV

SEQ ID NO: 4792 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4793 - DNA, 336 bp, Artificial Sequence; identical to SEQ ID NO: 3865
  Description of Artificial Sequence: Synthetic Light chain variable region nucleic acid sequence

SEQ ID NO: 4794 - protein, 112 aa, Artificial Sequence; identical to SEQ ID NO: 3866
  Description of Artificial Sequence: Synthetic Light chain variable region amino acid sequence

SEQ ID NO: 4795 - protein, 17 aa, Artificial Sequence
  Description of Artificial Sequence: Synthetic Light chain variable region CDR L1 amino acid sequence
KSSQSLLNSRTGKNYLA

SEQ ID NO: 4796 - DNA, 51 bp, Artificial Sequence; identical to SEQ ID NO: 3868
  Description of Artificial Sequence: Synthetic Light chain variable region CDR L1 nucleic acid sequence

SEQ ID NO: 4797 - protein, 7 aa, Artificial Sequence
  Description of Artificial Sequence: Synthetic Light chain variable region CDR L2 amino acid sequence
WASTRES

SEQ ID NO: 4798 - DNA, 21 bp, Artificial Sequence
  Description of Artificial Sequence: Synthetic Light chain variable region CDR L2 nucleic acid sequence
tgggcatctacccgggaatcc

SEQ ID NO: 4799 - protein, 8 aa, Artificial Sequence
  Description of Artificial Sequence: Synthetic Light chain variable region CDR L3 amino acid sequence
KQSYSRRT

SEQ ID NO: 4800 - DNA, 24 bp, Artificial Sequence
  Description of Artificial Sequence: Synthetic Light chain variable region CDR L3 nucleic acid sequence
aagcaatcttattctcggagaact

SEQ ID NO: 4801 - DNA, 357 bp, Artificial Sequence; identical to SEQ ID NO: 4161
  Description of Artificial Sequence: Synthetic Heavy chain variable region nucleic acid sequence

SEQ ID NO: 4802 - protein, 119 aa, Artificial Sequence; identical to SEQ ID NO: 4162
  Description of Artificial Sequence: Synthetic Heavy chain variable region amino acid sequence

SEQ ID NO: 4803 - protein, 9 aa, Artificial Sequence
  Description of Artificial Sequence: Synthetic Heavy chain variable region CDR H1 amino acid sequence
FNIKDYYMH

SEQ ID NO: 4804 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4805 - protein, 17 aa, Artificial Sequence
  Description of Artificial Sequence: Synthetic Heavy chain variable region CDR H2 amino acid sequence
WIDLENGNTIYDPKFQG

SEQ ID NO: 4806 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4807 - protein, 12 aa, Artificial Sequence
  Description of Artificial Sequence: Synthetic Heavy chain variable region CDR H3 amino acid sequence
ARDGYGRYFYDV

SEQ ID NO: 4808 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4809 - DNA, 336 bp, Artificial Sequence; identical to SEQ ID NO: 3865
  Description of Artificial Sequence: Synthetic Light chain variable region nucleic acid sequence

SEQ ID NO: 4810 - protein, 112 aa, Artificial Sequence; identical to SEQ ID NO: 3866
  Description of Artificial Sequence: Synthetic Light chain variable region amino acid sequence

SEQ ID NO: 4811 - protein, 17 aa, Artificial Sequence
  Description of Artificial Sequence: Synthetic Light chain variable region CDR L1 amino acid sequence
KSSQSLLNSRTGKNYLA

SEQ ID NO: 4812 - DNA, 51 bp, Artificial Sequence; identical to SEQ ID NO: 3868
  Description of Artificial Sequence: Synthetic Light chain variable region CDR L1 nucleic acid sequence

SEQ ID NO: 4813 - protein, 7 aa, Artificial Sequence
  Description of Artificial Sequence: Synthetic Light chain variable region CDR L2 amino acid sequence
WASTRES

SEQ ID NO: 4814 - DNA, 21 bp, Artificial Sequence
  Description of Artificial Sequence: Synthetic Light chain variable region CDR L2 nucleic acid sequence
tgggcatctacccgggaatcc

SEQ ID NO: 4815 - protein, 8 aa, Artificial Sequence
  Description of Artificial Sequence: Synthetic Light chain variable region CDR L3 amino acid sequence
KQSYSRRT

SEQ ID NO: 4816 - DNA, 24 bp, Artificial Sequence
  Description of Artificial Sequence: Synthetic Light chain variable region CDR L3 nucleic acid sequence
aagcaatcttattctcggagaact

SEQ ID NO: 4817 - DNA, 357 bp, Artificial Sequence; identical to SEQ ID NO: 4161
  Description of Artificial Sequence: Synthetic Heavy chain variable region nucleic acid sequence

SEQ ID NO: 4818 - protein, 119 aa, Artificial Sequence; identical to SEQ ID NO: 4162
  Description of Artificial Sequence: Synthetic Heavy chain variable region amino acid sequence

SEQ ID NO: 4819 - protein, 9 aa, Artificial Sequence
  Description of Artificial Sequence: Synthetic Heavy chain variable region CDR H1 amino acid sequence
FNIKDYYMH

SEQ ID NO: 4820 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4821 - protein, 17 aa, Artificial Sequence
  Description of Artificial Sequence: Synthetic Heavy chain variable region CDR H2 amino acid sequence
WIDLENGNTIYDPKFQG

SEQ ID NO: 4822 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4823 - protein, 12 aa, Artificial Sequence
  Description of Artificial Sequence: Synthetic Heavy chain variable region CDR H3 amino acid sequence
ARDGYGRYFYDV

SEQ ID NO: 4824 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4825 - DNA, 336 bp, Artificial Sequence; identical to SEQ ID NO: 3865
  Description of Artificial Sequence: Synthetic Light chain variable region nucleic acid sequence

SEQ ID NO: 4826 - protein, 112 aa, Artificial Sequence; identical to SEQ ID NO: 3866
  Description of Artificial Sequence: Synthetic Light chain variable region amino acid sequence

SEQ ID NO: 4827 - protein, 17 aa, Artificial Sequence
  Description of Artificial Sequence: Synthetic Light chain variable region CDR L1 amino acid sequence
KSSQSLLNSRTGKNYLA

SEQ ID NO: 4828 - DNA, 51 bp, Artificial Sequence; identical to SEQ ID NO: 3868
  Description of Artificial Sequence: Synthetic Light chain variable region CDR L1 nucleic acid sequence

SEQ ID NO: 4829 - protein, 7 aa, Artificial Sequence
  Description of Artificial Sequence: Synthetic Light chain variable region CDR L2 amino acid sequence
WASTRES

SEQ ID NO: 4830 - DNA, 21 bp, Artificial Sequence
  Description of Artificial Sequence: Synthetic Light chain variable region CDR L2 nucleic acid sequence
tgggcatctacccgggaatcc

SEQ ID NO: 4831 - protein, 8 aa, Artificial Sequence
  Description of Artificial Sequence: Synthetic Light chain variable region CDR L3 amino acid sequence
KQSYSRRT

SEQ ID NO: 4832 - DNA, 24 bp, Artificial Sequence
  Description of Artificial Sequence: Synthetic Light chain variable region CDR L3 nucleic acid sequence
aagcaatcttattctcggagaact

SEQ ID NO: 4833 - DNA, 357 bp, Artificial Sequence; identical to SEQ ID NO: 4161
  Description of Artificial Sequence: Synthetic Heavy chain variable region nucleic acid sequence

SEQ ID NO: 4834 - protein, 119 aa, Artificial Sequence; identical to SEQ ID NO: 4162
  Description of Artificial Sequence: Synthetic Heavy chain variable region amino acid sequence

SEQ ID NO: 4835 - protein, 9 aa, Artificial Sequence
  Description of Artificial Sequence: Synthetic Heavy chain variable region CDR H1 amino acid sequence
FNIKDYYMH

SEQ ID NO: 4836 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4837 - protein, 17 aa, Artificial Sequence
  Description of Artificial Sequence: Synthetic Heavy chain variable region CDR H2 amino acid sequence
WIDLENGNTIYDPKFQG

SEQ ID NO: 4838 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4839 - protein, 12 aa, Artificial Sequence
  Description of Artificial Sequence: Synthetic Heavy chain variable region CDR H3 amino acid sequence
ARDGYGRYFYDV

SEQ ID NO: 4840 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4841 - DNA, 336 bp, Artificial Sequence; identical to SEQ ID NO: 3865
  Description of Artificial Sequence: Synthetic Light chain variable region nucleic acid sequence

SEQ ID NO: 4842 - protein, 112 aa, Artificial Sequence; identical to SEQ ID NO: 3866
  Description of Artificial Sequence: Synthetic Light chain variable region amino acid sequence

SEQ ID NO: 4843 - protein, 17 aa, Artificial Sequence
  Description of Artificial Sequence: Synthetic Light chain variable region CDR L1 amino acid sequence
KSSQSLLNSRTGKNYLA

SEQ ID NO: 4844 - DNA, 51 bp, Artificial Sequence; identical to SEQ ID NO: 3868
  Description of Artificial Sequence: Synthetic Light chain variable region CDR L1 nucleic acid sequence

SEQ ID NO: 4845 - protein, 7 aa, Artificial Sequence
  Description of Artificial Sequence: Synthetic Light chain variable region CDR L2 amino acid sequence
WASTRES

SEQ ID NO: 4846 - DNA, 21 bp, Artificial Sequence
  Description of Artificial Sequence: Synthetic Light chain variable region CDR L2 nucleic acid sequence
tgggcatctacccgggaatcc

SEQ ID NO: 4847 - protein, 8 aa, Artificial Sequence
  Description of Artificial Sequence: Synthetic Light chain variable region CDR L3 amino acid sequence
KQSYSRRT

SEQ ID NO: 4848 - DNA, 24 bp, Artificial Sequence
  Description of Artificial Sequence: Synthetic Light chain variable region CDR L3 nucleic acid sequence
aagcaatcttattctcggagaact

SEQ ID NO: 4849 - DNA, 357 bp, Artificial Sequence; identical to SEQ ID NO: 4161
  Description of Artificial Sequence: Synthetic Heavy chain variable region nucleic acid sequence

SEQ ID NO: 4850 - protein, 119 aa, Artificial Sequence; identical to SEQ ID NO: 4162
  Description of Artificial Sequence: Synthetic Heavy chain variable region amino acid sequence

SEQ ID NO: 4851 - protein, 9 aa, Artificial Sequence
  Description of Artificial Sequence: Synthetic Heavy chain variable region CDR H1 amino acid sequence
FNIKDYYMH

SEQ ID NO: 4852 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4853 - protein, 17 aa, Artificial Sequence
  Description of Artificial Sequence: Synthetic Heavy chain variable region CDR H2 amino acid sequence
WIDLENGNTIYDPKFQG

SEQ ID NO: 4854 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4855 - protein, 12 aa, Artificial Sequence
  Description of Artificial Sequence: Synthetic Heavy chain variable region CDR H3 amino acid sequence
ARDGYGRYFYDV

SEQ ID NO: 4856 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4857 - DNA, 336 bp, Artificial Sequence; identical to SEQ ID NO: 3865
  Description of Artificial Sequence: Synthetic Light chain variable region nucleic acid sequence

SEQ ID NO: 4858 - protein, 112 aa, Artificial Sequence; identical to SEQ ID NO: 3866
  Description of Artificial Sequence: Synthetic Light chain variable region amino acid sequence

SEQ ID NO: 4859 - protein, 17 aa, Artificial Sequence
  Description of Artificial Sequence: Synthetic Light chain variable region CDR L1 amino acid sequence
KSSQSLLNSRTGKNYLA

SEQ ID NO: 4860 - DNA, 51 bp, Artificial Sequence; identical to SEQ ID NO: 3868
  Description of Artificial Sequence: Synthetic Light chain variable region CDR L1 nucleic acid sequence

SEQ ID NO: 4861 - protein, 7 aa, Artificial Sequence
  Description of Artificial Sequence: Synthetic Light chain variable region CDR L2 amino acid sequence
WASTRES

SEQ ID NO: 4862 - DNA, 21 bp, Artificial Sequence
  Description of Artificial Sequence: Synthetic Light chain variable region CDR L2 nucleic acid sequence
tgggcatctacccgggaatcc

SEQ ID NO: 4863 - protein, 8 aa, Artificial Sequence
  Description of Artificial Sequence: Synthetic Light chain variable region CDR L3 amino acid sequence
KQSYSRRT

SEQ ID NO: 4864 - DNA, 24 bp, Artificial Sequence
  Description of Artificial Sequence: Synthetic Light chain variable region CDR L3 nucleic acid sequence
aagcaatcttattctcggagaact

SEQ ID NO: 4865 - DNA, 357 bp, Artificial Sequence; identical to SEQ ID NO: 4161
  Description of Artificial Sequence: Synthetic Heavy chain variable region nucleic acid sequence

SEQ ID NO: 4866 - protein, 119 aa, Artificial Sequence; identical to SEQ ID NO: 4162
  Description of Artificial Sequence: Synthetic Heavy chain variable region amino acid sequence

SEQ ID NO: 4867 - protein, 9 aa, Artificial Sequence
  Description of Artificial Sequence: Synthetic Heavy chain variable region CDR H1 amino acid sequence
FNIKDYYMH

SEQ ID NO: 4868 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4869 - protein, 17 aa, Artificial Sequence
  Description of Artificial Sequence: Synthetic Heavy chain variable region CDR H2 amino acid sequence
WIDLENGNTIYDPKFQG

SEQ ID NO: 4870 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4871 - protein, 12 aa, Artificial Sequence
  Description of Artificial Sequence: Synthetic Heavy chain variable region CDR H3 amino acid sequence
ARDGYGRYFYDV

SEQ ID NO: 4872 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4873 - DNA, 336 bp, Artificial Sequence; identical to SEQ ID NO: 3865
  Description of Artificial Sequence: Synthetic Light chain variable region nucleic acid sequence

SEQ ID NO: 4874 - protein, 112 aa, Artificial Sequence; identical to SEQ ID NO: 3866
  Description of Artificial Sequence: Synthetic Light chain variable region amino acid sequence

SEQ ID NO: 4875 - protein, 17 aa, Artificial Sequence
  Description of Artificial Sequence: Synthetic Light chain variable region CDR L1 amino acid sequence
KSSQSLLNSRTGKNYLA

SEQ ID NO: 4876 - DNA, 51 bp, Artificial Sequence; identical to SEQ ID NO: 3868
  Description of Artificial Sequence: Synthetic Light chain variable region CDR L1 nucleic acid sequence

SEQ ID NO: 4877 - protein, 7 aa, Artificial Sequence
  Description of Artificial Sequence: Synthetic Light chain variable region CDR L2 amino acid sequence
WASTRES

SEQ ID NO: 4878 - DNA, 21 bp, Artificial Sequence
  Description of Artificial Sequence: Synthetic Light chain variable region CDR L2 nucleic acid sequence
tgggcatctacccgggaatcc

SEQ ID NO: 4879 - protein, 8 aa, Artificial Sequence
  Description of Artificial Sequence: Synthetic Light chain variable region CDR L3 amino acid sequence
KQSYSRRT

SEQ ID NO: 4880 - DNA, 24 bp, Artificial Sequence
  Description of Artificial Sequence: Synthetic Light chain variable region CDR L3 nucleic acid sequence
aagcaatcttattctcggagaact

SEQ ID NO: 4881 - DNA, 357 bp, Artificial Sequence; identical to SEQ ID NO: 4161
  Description of Artificial Sequence: Synthetic Heavy chain variable region nucleic acid sequence

SEQ ID NO: 4882 - protein, 119 aa, Artificial Sequence; identical to SEQ ID NO: 4162
  Description of Artificial Sequence: Synthetic Heavy chain variable region amino acid sequence

SEQ ID NO: 4883 - protein, 9 aa, Artificial Sequence
  Description of Artificial Sequence: Synthetic Heavy chain variable region CDR H1 amino acid sequence
FNIKDYYMH

SEQ ID NO: 4884 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4885 - protein, 17 aa, Artificial Sequence
  Description of Artificial Sequence: Synthetic Heavy chain variable region CDR H2 amino acid sequence
WIDLENGNTIYDPKFQG

SEQ ID NO: 4886 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4887 - protein, 12 aa, Artificial Sequence
  Description of Artificial Sequence: Synthetic Heavy chain variable region CDR H3 amino acid sequence
ARDGYGRYFYDV

SEQ ID NO: 4888 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4889 - DNA, 336 bp, Artificial Sequence; identical to SEQ ID NO: 3865
  Description of Artificial Sequence: Synthetic Light chain variable region nucleic acid sequence

SEQ ID NO: 4890 - protein, 112 aa, Artificial Sequence; identical to SEQ ID NO: 3866
  Description of Artificial Sequence: Synthetic Light chain variable region amino acid sequence

SEQ ID NO: 4891 - protein, 17 aa, Artificial Sequence
  Description of Artificial Sequence: Synthetic Light chain variable region CDR L1 amino acid sequence
KSSQSLLNSRTGKNYLA

SEQ ID NO: 4892 - DNA, 51 bp, Artificial Sequence; identical to SEQ ID NO: 3868
  Description of Artificial Sequence: Synthetic Light chain variable region CDR L1 nucleic acid sequence

SEQ ID NO: 4893 - protein, 7 aa, Artificial Sequence
  Description of Artificial Sequence: Synthetic Light chain variable region CDR L2 amino acid sequence
WASTRES

SEQ ID NO: 4894 - DNA, 21 bp, Artificial Sequence
  Description of Artificial Sequence: Synthetic Light chain variable region CDR L2 nucleic acid sequence
tgggcatctacccgggaatcc

SEQ ID NO: 4895 - protein, 8 aa, Artificial Sequence
  Description of Artificial Sequence: Synthetic Light chain variable region CDR L3 amino acid sequence
KQSYSRRT

SEQ ID NO: 4896 - DNA, 24 bp, Artificial Sequence
  Description of Artificial Sequence: Synthetic Light chain variable region CDR L3 nucleic acid sequence
aagcaatcttattctcggagaact

SEQ ID NO: 4897 - DNA, 357 bp, Artificial Sequence; identical to SEQ ID NO: 4161
  Description of Artificial Sequence: Synthetic Heavy chain variable region nucleic acid sequence

SEQ ID NO: 4898 - protein, 119 aa, Artificial Sequence; identical to SEQ ID NO: 4162
  Description of Artificial Sequence: Synthetic Heavy chain variable region amino acid sequence

SEQ ID NO: 4899 - protein, 9 aa, Artificial Sequence
  Description of Artificial Sequence: Synthetic Heavy chain variable region CDR H1 amino acid sequence
FNIKDYYMH

SEQ ID NO: 4900 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4901 - protein, 17 aa, Artificial Sequence
  Description of Artificial Sequence: Synthetic Heavy chain variable region CDR H2 amino acid sequence
WIDLENGNTIYDPKFQG

SEQ ID NO: 4902 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4903 - protein, 12 aa, Artificial Sequence
  Description of Artificial Sequence: Synthetic Heavy chain variable region CDR H3 amino acid sequence
ARDGYGRYFYDV

SEQ ID NO: 4904 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4905 - DNA, 336 bp, Artificial Sequence; identical to SEQ ID NO: 3865
  Description of Artificial Sequence: Synthetic Light chain variable region nucleic acid sequence

SEQ ID NO: 4906 - protein, 112 aa, Artificial Sequence; identical to SEQ ID NO: 3866
  Description of Artificial Sequence: Synthetic Light chain variable region amino acid sequence

SEQ ID NO: 4907 - protein, 17 aa, Artificial Sequence
  Description of Artificial Sequence: Synthetic Light chain variable region CDR L1 amino acid sequence
KSSQSLLNSRTGKNYLA

SEQ ID NO: 4908 - DNA, 51 bp, Artificial Sequence; identical to SEQ ID NO: 3868
  Description of Artificial Sequence: Synthetic Light chain variable region CDR L1 nucleic acid sequence

SEQ ID NO: 4909 - protein, 7 aa, Artificial Sequence
  Description of Artificial Sequence: Synthetic Light chain variable region CDR L2 amino acid sequence
WASTRES

SEQ ID NO: 4910 - DNA, 21 bp, Artificial Sequence
  Description of Artificial Sequence: Synthetic Light chain variable region CDR L2 nucleic acid sequence
tgggcatctacccgggaatcc

SEQ ID NO: 4911 - protein, 8 aa, Artificial Sequence
  Description of Artificial Sequence: Synthetic Light chain variable region CDR L3 amino acid sequence
KQSYSRRT

SEQ ID NO: 4912 - DNA, 24 bp, Artificial Sequence
  Description of Artificial Sequence: Synthetic Light chain variable region CDR L3 nucleic acid sequence
aagcaatcttattctcggagaact

SEQ ID NO: 4913 - DNA, 357 bp, Artificial Sequence; identical to SEQ ID NO: 4161
  Description of Artificial Sequence: Synthetic Heavy chain variable region nucleic acid sequence

SEQ ID NO: 4914 - protein, 119 aa, Artificial Sequence; identical to SEQ ID NO: 4162
  Description of Artificial Sequence: Synthetic Heavy chain variable region amino acid sequence

SEQ ID NO: 4915 - protein, 9 aa, Artificial Sequence
  Description of Artificial Sequence: Synthetic Heavy chain variable region CDR H1 amino acid sequence
FNIKDYYMH

SEQ ID NO: 4916 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4917 - protein, 17 aa, Artificial Sequence
  Description of Artificial Sequence: Synthetic Heavy chain variable region CDR H2 amino acid sequence
WIDLENGNTIYDPKFQG

SEQ ID NO: 4918 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4919 - protein, 12 aa, Artificial Sequence
  Description of Artificial Sequence: Synthetic Heavy chain variable region CDR H3 amino acid sequence
ARDGYGRYFYDV

SEQ ID NO: 4920 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4921 - DNA, 336 bp, Artificial Sequence; identical to SEQ ID NO: 3865
  Description of Artificial Sequence: Synthetic Light chain variable region nucleic acid sequence

SEQ ID NO: 4922 - protein, 112 aa, Artificial Sequence; identical to SEQ ID NO: 3866
  Description of Artificial Sequence: Synthetic Light chain variable region amino acid sequence

SEQ ID NO: 4923 - protein, 17 aa, Artificial Sequence
  Description of Artificial Sequence: Synthetic Light chain variable region CDR L1 amino acid sequence
KSSQSLLNSRTGKNYLA

SEQ ID NO: 4924 - DNA, 51 bp, Artificial Sequence; identical to SEQ ID NO: 3868
  Description of Artificial Sequence: Synthetic Light chain variable region CDR L1 nucleic acid sequence

SEQ ID NO: 4925 - protein, 7 aa, Artificial Sequence
  Description of Artificial Sequence: Synthetic Light chain variable region CDR L2 amino acid sequence
WASTRES

SEQ ID NO: 4926 - DNA, 21 bp, Artificial Sequence
  Description of Artificial Sequence: Synthetic Light chain variable region CDR L2 nucleic acid sequence
tgggcatctacccgggaatcc

SEQ ID NO: 4927 - protein, 8 aa, Artificial Sequence
  Description of Artificial Sequence: Synthetic Light chain variable region CDR L3 amino acid sequence
KQSYSRRT

SEQ ID NO: 4928 - DNA, 24 bp, Artificial Sequence
  Description of Artificial Sequence: Synthetic Light chain variable region CDR L3 nucleic acid sequence
aagcaatcttattctcggagaact

SEQ ID NO: 4929 - DNA, 357 bp, Artificial Sequence; identical to SEQ ID NO: 4161
  Description of Artificial Sequence: Synthetic Heavy chain variable region nucleic acid sequence

SEQ ID NO: 4930 - protein, 119 aa, Artificial Sequence; identical to SEQ ID NO: 4162
  Description of Artificial Sequence: Synthetic Heavy chain variable region amino acid sequence

SEQ ID NO: 4931 - protein, 9 aa, Artificial Sequence
  Description of Artificial Sequence: Synthetic Heavy chain variable region CDR H1 amino acid sequence
FNIKDYYMH

SEQ ID NO: 4932 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4933 - protein, 17 aa, Artificial Sequence
  Description of Artificial Sequence: Synthetic Heavy chain variable region CDR H2 amino acid sequence
WIDLENGNTIYDPKFQG

SEQ ID NO: 4934 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4935 - protein, 12 aa, Artificial Sequence
  Description of Artificial Sequence: Synthetic Heavy chain variable region CDR H3 amino acid sequence
ARDGYGRYFYDV

SEQ ID NO: 4936 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4937 - DNA, 336 bp, Artificial Sequence; identical to SEQ ID NO: 3865
  Description of Artificial Sequence: Synthetic Light chain variable region nucleic acid sequence

SEQ ID NO: 4938 - protein, 112 aa, Artificial Sequence; identical to SEQ ID NO: 3866
  Description of Artificial Sequence: Synthetic Light chain variable region amino acid sequence

SEQ ID NO: 4939 - protein, 17 aa, Artificial Sequence
  Description of Artificial Sequence: Synthetic Light chain variable region CDR L1 amino acid sequence
KSSQSLLNSRTGKNYLA

SEQ ID NO: 4940 - DNA, 51 bp, Artificial Sequence; identical to SEQ ID NO: 3868
  Description of Artificial Sequence: Synthetic Light chain variable region CDR L1 nucleic acid sequence

SEQ ID NO: 4941 - protein, 7 aa, Artificial Sequence
  Description of Artificial Sequence: Synthetic Light chain variable region CDR L2 amino acid sequence
WASTRES

SEQ ID NO: 4942 - DNA, 21 bp, Artificial Sequence
  Description of Artificial Sequence: Synthetic Light chain variable region CDR L2 nucleic acid sequence
tgggcatctacccgggaatcc

SEQ ID NO: 4943 - protein, 8 aa, Artificial Sequence
  Description of Artificial Sequence: Synthetic Light chain variable region CDR L3 amino acid sequence
KQSYSRRT

SEQ ID NO: 4944 - DNA, 24 bp, Artificial Sequence
  Description of Artificial Sequence: Synthetic Light chain variable region CDR L3 nucleic acid sequence
aagcaatcttattctcggagaact

SEQ ID NO: 4945 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcagtgtactactgcgcgagagatggatacgggagatatttttacgacgtgtggggccaaggaaccctggtcaccgtctcctca

SEQ ID NO: 4946 - protein, 119 aa, Artificial Sequence; identical to SEQ ID NO: 4162
  Description of Artificial Sequence: Synthetic Heavy chain variable region amino acid sequence

SEQ ID NO: 4947 - protein, 9 aa, Artificial Sequence
  Description of Artificial Sequence: Synthetic Heavy chain variable region CDR H1 amino acid sequence
FNIKDYYMH

SEQ ID NO: 4948 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4949 - protein, 17 aa, Artificial Sequence
  Description of Artificial Sequence: Synthetic Heavy chain variable region CDR H2 amino acid sequence
WIDLENGNTIYDPKFQG

SEQ ID NO: 4950 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4951 - protein, 12 aa, Artificial Sequence
  Description of Artificial Sequence: Synthetic Heavy chain variable region CDR H3 amino acid sequence
ARDGYGRYFYDV

SEQ ID NO: 4952 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4953 - DNA, 336 bp, Artificial Sequence; identical to SEQ ID NO: 3865
  Description of Artificial Sequence: Synthetic Light chain variable region nucleic acid sequence

SEQ ID NO: 4954 - protein, 112 aa, Artificial Sequence; identical to SEQ ID NO: 3866
  Description of Artificial Sequence: Synthetic Light chain variable region amino acid sequence

SEQ ID NO: 4955 - protein, 17 aa, Artificial Sequence
  Description of Artificial Sequence: Synthetic Light chain variable region CDR L1 amino acid sequence
KSSQSLLNSRTGKNYLA

SEQ ID NO: 4956 - DNA, 51 bp, Artificial Sequence; identical to SEQ ID NO: 3868
  Description of Artificial Sequence: Synthetic Light chain variable region CDR L1 nucleic acid sequence

SEQ ID NO: 4957 - protein, 7 aa, Artificial Sequence
  Description of Artificial Sequence: Synthetic Light chain variable region CDR L2 amino acid sequence
WASTRES

SEQ ID NO: 4958 - DNA, 21 bp, Artificial Sequence
  Description of Artificial Sequence: Synthetic Light chain variable region CDR L2 nucleic acid sequence
tgggcatctacccgggaatcc

SEQ ID NO: 4959 - protein, 8 aa, Artificial Sequence
  Description of Artificial Sequence: Synthetic Light chain variable region CDR L3 amino acid sequence
KQSYSRRT

SEQ ID NO: 4960 - DNA, 24 bp, Artificial Sequence
  Description of Artificial Sequence: Synthetic Light chain variable region CDR L3 nucleic acid sequence
aagcaatcttattctcggagaact

SEQ ID NO: 4961 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaatgtcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 4962 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQCLEWMGWIDLENGNTIYDPKFQGRVTITRDTSASTAYMELSSLRSEDTAVYYCARDGYGRYFYDVWGQGTLVTVSS

SEQ ID NO: 4963 - protein, 9 aa, Artificial Sequence
  Description of Artificial Sequence: Synthetic Heavy chain variable region CDR H1 amino acid sequence
FNIKDYYMH

SEQ ID NO: 4964 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4965 - protein, 17 aa, Artificial Sequence
  Description of Artificial Sequence: Synthetic Heavy chain variable region CDR H2 amino acid sequence
WIDLENGNTIYDPKFQG

SEQ ID NO: 4966 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4967 - protein, 12 aa, Artificial Sequence
  Description of Artificial Sequence: Synthetic Heavy chain variable region CDR H3 amino acid sequence
ARDGYGRYFYDV

SEQ ID NO: 4968 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4969 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccggaaagaactacttagcttggtaccagcagaaaccaggacagcctcctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctcggagaactttcggctgtgggaccaaggtcgagatcaaa

SEQ ID NO: 4970 - protein, 112 aa, Artificial Sequence
  Description of Artificial Sequence: Synthetic Light chain variable region amino acid sequence
DIVMTQSPDSLAVSLGERATINCKSSQSLLNSRTGKNYLAWYQQKPGQPPKLLIYWASTRESGVPDRFSGSGSGTDFTLTISSLQAEDVAVYYCKQSYSRRTFGCGTKVEIK

SEQ ID NO: 4971 - protein, 17 aa, Artificial Sequence
  Description of Artificial Sequence: Synthetic Light chain variable region CDR L1 amino acid sequence
KSSQSLLNSRTGKNYLA

SEQ ID NO: 4972 - DNA, 51 bp, Artificial Sequence; identical to SEQ ID NO: 3868
  Description of Artificial Sequence: Synthetic Light chain variable region CDR L1 nucleic acid sequence

SEQ ID NO: 4973 - protein, 7 aa, Artificial Sequence
  Description of Artificial Sequence: Synthetic Light chain variable region CDR L2 amino acid sequence
WASTRES

SEQ ID NO: 4974 - DNA, 21 bp, Artificial Sequence
  Description of Artificial Sequence: Synthetic Light chain variable region CDR L2 nucleic acid sequence
tgggcatctacccgggaatcc

SEQ ID NO: 4975 - protein, 8 aa, Artificial Sequence
  Description of Artificial Sequence: Synthetic Light chain variable region CDR L3 amino acid sequence
KQSYSRRT

SEQ ID NO: 4976 - DNA, 24 bp, Artificial Sequence
  Description of Artificial Sequence: Synthetic Light chain variable region CDR L3 nucleic acid sequence
aagcaatcttattctcggagaact

SEQ ID NO: 4977 - DNA, 357 bp, Artificial Sequence; identical to SEQ ID NO: 4961
  Description of Artificial Sequence: Synthetic Heavy chain variable region nucleic acid sequence

SEQ ID NO: 4978 - protein, 119 aa, Artificial Sequence; identical to SEQ ID NO: 4962
  Description of Artificial Sequence: Synthetic Heavy chain variable region amino acid sequence

SEQ ID NO: 4979 - protein, 9 aa, Artificial Sequence
  Description of Artificial Sequence: Synthetic Heavy chain variable region CDR H1 amino acid sequence
FNIKDYYMH

SEQ ID NO: 4980 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4981 - protein, 17 aa, Artificial Sequence
  Description of Artificial Sequence: Synthetic Heavy chain variable region CDR H2 amino acid sequence
WIDLENGNTIYDPKFQG

SEQ ID NO: 4982 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4983 - protein, 12 aa, Artificial Sequence
  Description of Artificial Sequence: Synthetic Heavy chain variable region CDR H3 amino acid sequence
ARDGYGRYFYDV

SEQ ID NO: 4984 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 4985 - DNA, 336 bp, Artificial Sequence; identical to SEQ ID NO: 4969
  Description of Artificial Sequence: Synthetic Light chain variable region nucleic acid sequence

SEQ ID NO: 4986 - protein, 112 aa, Artificial Sequence; identical to SEQ ID NO: 4970
  Description of Artificial Sequence: Synthetic Light chain variable region amino acid sequence

SEQ ID NO: 4987 - protein, 17 aa, Artificial Sequence
  Description of Artificial Sequence: Synthetic Light chain variable region CDR L1 amino acid sequence
KSSQSLLNSRTGKNYLA

SEQ ID NO: 4988 - DNA, 51 bp, Artificial Sequence; identical to SEQ ID NO: 3868
  Description of Artificial Sequence: Synthetic Light chain variable region CDR L1 nucleic acid sequence

SEQ ID NO: 4989 - protein, 7 aa, Artificial Sequence
  Description of Artificial Sequence: Synthetic Light chain variable region CDR L2 amino acid sequence
WASTRES

SEQ ID NO: 4990 - DNA, 21 bp, Artificial Sequence
  Description of Artificial Sequence: Synthetic Light chain variable region CDR L2 nucleic acid sequence
tgggcatctacccgggaatcc

SEQ ID NO: 4991 - protein, 8 aa, Artificial Sequence
  Description of Artificial Sequence: Synthetic Light chain variable region CDR L3 amino acid sequence
KQSYSRRT

SEQ ID NO: 4992 - DNA, 24 bp, Artificial Sequence
  Description of Artificial Sequence: Synthetic Light chain variable region CDR L3 nucleic acid sequence
aagcaatcttattctcggagaact

SEQ ID NO: 4993 - DNA, 357 bp, Artificial Sequence; identical to SEQ ID NO: 4961
  Description of Artificial Sequence: Synthetic Heavy chain variable region nucleic acid sequence

SEQ ID NO: 4994 - protein, 119 aa, Artificial Sequence; identical to SEQ ID NO: 4962
  Description of Artificial Sequence: Synthetic Heavy chain variable region amino acid sequence

SEQ ID NO: 4995 - protein, 9 aa, Artificial Sequence
  Description of Artificial Sequence: Synthetic Heavy chain variable region CDR H1 amino acid sequence
FNIKDYYMH

SEQ ID NO: 4996 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 4997 - protein, 17 aa, Artificial Sequence
  Description of Artificial Sequence: Synthetic Heavy chain variable region CDR H2 amino acid sequence
WIDLENGNTIYDPKFQG

SEQ ID NO: 4998 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 4999 - protein, 12 aa, Artificial Sequence
  Description of Artificial Sequence: Synthetic Heavy chain variable region CDR H3 amino acid sequence
ARDGYGRYFYDV

SEQ ID NO: 5000 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5001 - DNA, 336 bp, Artificial Sequence; identical to SEQ ID NO: 4969
  Description of Artificial Sequence: Synthetic Light chain variable region nucleic acid sequence

SEQ ID NO: 5002 - protein, 112 aa, Artificial Sequence; identical to SEQ ID NO: 4970
  Description of Artificial Sequence: Synthetic Light chain variable region amino acid sequence

SEQ ID NO: 5003 - protein, 17 aa, Artificial Sequence
  Description of Artificial Sequence: Synthetic Light chain variable region CDR L1 amino acid sequence
KSSQSLLNSRTGKNYLA

SEQ ID NO: 5004 - DNA, 51 bp, Artificial Sequence; identical to SEQ ID NO: 3868
  Description of Artificial Sequence: Synthetic Light chain variable region CDR L1 nucleic acid sequence

SEQ ID NO: 5005 - protein, 7 aa, Artificial Sequence
  Description of Artificial Sequence: Synthetic Light chain variable region CDR L2 amino acid sequence
WASTRES

SEQ ID NO: 5006 - DNA, 21 bp, Artificial Sequence
  Description of Artificial Sequence: Synthetic Light chain variable region CDR L2 nucleic acid sequence
tgggcatctacccgggaatcc

SEQ ID NO: 5007 - protein, 8 aa, Artificial Sequence
  Description of Artificial Sequence: Synthetic Light chain variable region CDR L3 amino acid sequence
KQSYSRRT

SEQ ID NO: 5008 - DNA, 24 bp, Artificial Sequence
  Description of Artificial Sequence: Synthetic Light chain variable region CDR L3 nucleic acid sequence
aagcaatcttattctcggagaact

SEQ ID NO: 5009 - DNA, 357 bp, Artificial Sequence; identical to SEQ ID NO: 4961
  Description of Artificial Sequence: Synthetic Heavy chain variable region nucleic acid sequence

SEQ ID NO: 5010 - protein, 119 aa, Artificial Sequence; identical to SEQ ID NO: 4962
  Description of Artificial Sequence: Synthetic Heavy chain variable region amino acid sequence

SEQ ID NO: 5011 - protein, 9 aa, Artificial Sequence
  Description of Artificial Sequence: Synthetic Heavy chain variable region CDR H1 amino acid sequence
FNIKDYYMH

SEQ ID NO: 5012 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5013 - protein, 17 aa, Artificial Sequence
  Description of Artificial Sequence: Synthetic Heavy chain variable region CDR H2 amino acid sequence
WIDLENGNTIYDPKFQG

SEQ ID NO: 5014 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5015 - protein, 12 aa, Artificial Sequence
  Description of Artificial Sequence: Synthetic Heavy chain variable region CDR H3 amino acid sequence
ARDGYGRYFYDV

SEQ ID NO: 5016 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5017 - DNA, 336 bp, Artificial Sequence; identical to SEQ ID NO: 4969
  Description of Artificial Sequence: Synthetic Light chain variable region nucleic acid sequence

SEQ ID NO: 5018 - protein, 112 aa, Artificial Sequence; identical to SEQ ID NO: 4970
  Description of Artificial Sequence: Synthetic Light chain variable region amino acid sequence

SEQ ID NO: 5019 - protein, 17 aa, Artificial Sequence
  Description of Artificial Sequence: Synthetic Light chain variable region CDR L1 amino acid sequence
KSSQSLLNSRTGKNYLA

SEQ ID NO: 5020 - DNA, 51 bp, Artificial Sequence; identical to SEQ ID NO: 3868
  Description of Artificial Sequence: Synthetic Light chain variable region CDR L1 nucleic acid sequence

SEQ ID NO: 5021 - protein, 7 aa, Artificial Sequence
  Description of Artificial Sequence: Synthetic Light chain variable region CDR L2 amino acid sequence
WASTRES

SEQ ID NO: 5022 - DNA, 21 bp, Artificial Sequence
  Description of Artificial Sequence: Synthetic Light chain variable region CDR L2 nucleic acid sequence
tgggcatctacccgggaatcc

SEQ ID NO: 5023 - protein, 8 aa, Artificial Sequence
  Description of Artificial Sequence: Synthetic Light chain variable region CDR L3 amino acid sequence
KQSYSRRT

SEQ ID NO: 5024 - DNA, 24 bp, Artificial Sequence
  Description of Artificial Sequence: Synthetic Light chain variable region CDR L3 nucleic acid sequence
aagcaatcttattctcggagaact

SEQ ID NO: 5025 - DNA, 357 bp, Artificial Sequence; identical to SEQ ID NO: 4961
  Description of Artificial Sequence: Synthetic Heavy chain variable region nucleic acid sequence

SEQ ID NO: 5026 - protein, 119 aa, Artificial Sequence; identical to SEQ ID NO: 4962
  Description of Artificial Sequence: Synthetic Heavy chain variable region amino acid sequence

SEQ ID NO: 5027 - protein, 9 aa, Artificial Sequence
  Description of Artificial Sequence: Synthetic Heavy chain variable region CDR H1 amino acid sequence
FNIKDYYMH

SEQ ID NO: 5028 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5029 - protein, 17 aa, Artificial Sequence
  Description of Artificial Sequence: Synthetic Heavy chain variable region CDR H2 amino acid sequence
WIDLENGNTIYDPKFQG

SEQ ID NO: 5030 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5031 - protein, 12 aa, Artificial Sequence
  Description of Artificial Sequence: Synthetic Heavy chain variable region CDR H3 amino acid sequence
ARDGYGRYFYDV

SEQ ID NO: 5032 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5033 - DNA, 336 bp, Artificial Sequence; identical to SEQ ID NO: 4969
  Description of Artificial Sequence: Synthetic Light chain variable region nucleic acid sequence

SEQ ID NO: 5034 - protein, 112 aa, Artificial Sequence; identical to SEQ ID NO: 4970
  Description of Artificial Sequence: Synthetic Light chain variable region amino acid sequence

SEQ ID NO: 5035 - protein, 17 aa, Artificial Sequence
  Description of Artificial Sequence: Synthetic Light chain variable region CDR L1 amino acid sequence
KSSQSLLNSRTGKNYLA

SEQ ID NO: 5036 - DNA, 51 bp, Artificial Sequence; identical to SEQ ID NO: 3868
  Description of Artificial Sequence: Synthetic Light chain variable region CDR L1 nucleic acid sequence

SEQ ID NO: 5037 - protein, 7 aa, Artificial Sequence
  Description of Artificial Sequence: Synthetic Light chain variable region CDR L2 amino acid sequence
WASTRES

SEQ ID NO: 5038 - DNA, 21 bp, Artificial Sequence
  Description of Artificial Sequence: Synthetic Light chain variable region CDR L2 nucleic acid sequence
tgggcatctacccgggaatcc

SEQ ID NO: 5039 - protein, 8 aa, Artificial Sequence
  Description of Artificial Sequence: Synthetic Light chain variable region CDR L3 amino acid sequence
KQSYSRRT

SEQ ID NO: 5040 - DNA, 24 bp, Artificial Sequence
  Description of Artificial Sequence: Synthetic Light chain variable region CDR L3 nucleic acid sequence
aagcaatcttattctcggagaact

SEQ ID NO: 5041 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaatgtcttgagtggatgggatggatcgaccttgaaaatggtaacacaatctatgacccgatgtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 5042 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQCLEWMGWIDLENGNTIYDPMFQGRVTITRDTSASTAYMELSSLRSEDTAVYYCARDGYGRYFYDVWGQGTLVTVSS

SEQ ID NO: 5043 - protein, 9 aa, Artificial Sequence
  Description of Artificial Sequence: Synthetic Heavy chain variable region CDR H1 amino acid sequence
FNIKDYYMH

SEQ ID NO: 5044 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5045 - protein, 17 aa, Artificial Sequence
  Description of Artificial Sequence: Synthetic Heavy chain variable region CDR H2 amino acid sequence
WIDLENGNTIYDPMFQG

SEQ ID NO: 5046 - DNA, 51 bp, Artificial Sequence
  Description of Artificial Sequence: Synthetic Heavy chain variable region CDR H2 nucleic acid sequence
tggatcgaccttgaaaatggtaacacaatctatgacccgatgtttcagggc

SEQ ID NO: 5047 - protein, 12 aa, Artificial Sequence
  Description of Artificial Sequence: Synthetic Heavy chain variable region CDR H3 amino acid sequence
ARDGYGRYFYDV

SEQ ID NO: 5048 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5049 - DNA, 336 bp, Artificial Sequence; identical to SEQ ID NO: 4969
  Description of Artificial Sequence: Synthetic Light chain variable region nucleic acid sequence

SEQ ID NO: 5050 - protein, 112 aa, Artificial Sequence; identical to SEQ ID NO: 4970
  Description of Artificial Sequence: Synthetic Light chain variable region amino acid sequence

SEQ ID NO: 5051 - protein, 17 aa, Artificial Sequence
  Description of Artificial Sequence: Synthetic Light chain variable region CDR L1 amino acid sequence
KSSQSLLNSRTGKNYLA

SEQ ID NO: 5052 - DNA, 51 bp, Artificial Sequence; identical to SEQ ID NO: 3868
  Description of Artificial Sequence: Synthetic Light chain variable region CDR L1 nucleic acid sequence

SEQ ID NO: 5053 - protein, 7 aa, Artificial Sequence
  Description of Artificial Sequence: Synthetic Light chain variable region CDR L2 amino acid sequence
WASTRES

SEQ ID NO: 5054 - DNA, 21 bp, Artificial Sequence
  Description of Artificial Sequence: Synthetic Light chain variable region CDR L2 nucleic acid sequence
tgggcatctacccgggaatcc

SEQ ID NO: 5055 - protein, 8 aa, Artificial Sequence
  Description of Artificial Sequence: Synthetic Light chain variable region CDR L3 amino acid sequence
KQSYSRRT

SEQ ID NO: 5056 - DNA, 24 bp, Artificial Sequence
  Description of Artificial Sequence: Synthetic Light chain variable region CDR L3 nucleic acid sequence
aagcaatcttattctcggagaact

SEQ ID NO: 5057 - DNA, 357 bp, Artificial Sequence; identical to SEQ ID NO: 4961
  Description of Artificial Sequence: Synthetic Heavy chain variable region nucleic acid sequence

SEQ ID NO: 5058 - protein, 119 aa, Artificial Sequence; identical to SEQ ID NO: 4962
  Description of Artificial Sequence: Synthetic Heavy chain variable region amino acid sequence

SEQ ID NO: 5059 - protein, 9 aa, Artificial Sequence
  Description of Artificial Sequence: Synthetic Heavy chain variable region CDR H1 amino acid sequence
FNIKDYYMH

SEQ ID NO: 5060 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5061 - protein, 17 aa, Artificial Sequence
  Description of Artificial Sequence: Synthetic Heavy chain variable region CDR H2 amino acid sequence
WIDLENGNTIYDPKFQG

SEQ ID NO: 5062 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5063 - protein, 12 aa, Artificial Sequence
  Description of Artificial Sequence: Synthetic Heavy chain variable region CDR H3 amino acid sequence
ARDGYGRYFYDV

SEQ ID NO: 5064 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5065 - DNA, 336 bp, Artificial Sequence; identical to SEQ ID NO: 4969
  Description of Artificial Sequence: Synthetic Light chain variable region nucleic acid sequence

SEQ ID NO: 5066 - protein, 112 aa, Artificial Sequence; identical to SEQ ID NO: 4970
  Description of Artificial Sequence: Synthetic Light chain variable region amino acid sequence

SEQ ID NO: 5067 - protein, 17 aa, Artificial Sequence
  Description of Artificial Sequence: Synthetic Light chain variable region CDR L1 amino acid sequence
KSSQSLLNSRTGKNYLA

SEQ ID NO: 5068 - DNA, 51 bp, Artificial Sequence; identical to SEQ ID NO: 3868
  Description of Artificial Sequence: Synthetic Light chain variable region CDR L1 nucleic acid sequence

SEQ ID NO: 5069 - protein, 7 aa, Artificial Sequence
  Description of Artificial Sequence: Synthetic Light chain variable region CDR L2 amino acid sequence
WASTRES

SEQ ID NO: 5070 - DNA, 21 bp, Artificial Sequence
  Description of Artificial Sequence: Synthetic Light chain variable region CDR L2 nucleic acid sequence
tgggcatctacccgggaatcc

SEQ ID NO: 5071 - protein, 8 aa, Artificial Sequence
  Description of Artificial Sequence: Synthetic Light chain variable region CDR L3 amino acid sequence
KQSYSRRT

SEQ ID NO: 5072 - DNA, 24 bp, Artificial Sequence
  Description of Artificial Sequence: Synthetic Light chain variable region CDR L3 nucleic acid sequence
aagcaatcttattctcggagaact

SEQ ID NO: 5073 - DNA, 357 bp, Artificial Sequence; identical to SEQ ID NO: 4961
  Description of Artificial Sequence: Synthetic Heavy chain variable region nucleic acid sequence

SEQ ID NO: 5074 - protein, 119 aa, Artificial Sequence; identical to SEQ ID NO: 4962
  Description of Artificial Sequence: Synthetic Heavy chain variable region amino acid sequence

SEQ ID NO: 5075 - protein, 9 aa, Artificial Sequence
  Description of Artificial Sequence: Synthetic Heavy chain variable region CDR H1 amino acid sequence
FNIKDYYMH

SEQ ID NO: 5076 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5077 - protein, 17 aa, Artificial Sequence
  Description of Artificial Sequence: Synthetic Heavy chain variable region CDR H2 amino acid sequence
WIDLENGNTIYDPKFQG

SEQ ID NO: 5078 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5079 - protein, 12 aa, Artificial Sequence
  Description of Artificial Sequence: Synthetic Heavy chain variable region CDR H3 amino acid sequence
ARDGYGRYFYDV

SEQ ID NO: 5080 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5081 - DNA, 336 bp, Artificial Sequence; identical to SEQ ID NO: 4969
  Description of Artificial Sequence: Synthetic Light chain variable region nucleic acid sequence

SEQ ID NO: 5082 - protein, 112 aa, Artificial Sequence; identical to SEQ ID NO: 4970
  Description of Artificial Sequence: Synthetic Light chain variable region amino acid sequence

SEQ ID NO: 5083 - protein, 17 aa, Artificial Sequence
  Description of Artificial Sequence: Synthetic Light chain variable region CDR L1 amino acid sequence
KSSQSLLNSRTGKNYLA

SEQ ID NO: 5084 - DNA, 51 bp, Artificial Sequence; identical to SEQ ID NO: 3868
  Description of Artificial Sequence: Synthetic Light chain variable region CDR L1 nucleic acid sequence

SEQ ID NO: 5085 - protein, 7 aa, Artificial Sequence
  Description of Artificial Sequence: Synthetic Light chain variable region CDR L2 amino acid sequence
WASTRES

SEQ ID NO: 5086 - DNA, 21 bp, Artificial Sequence
  Description of Artificial Sequence: Synthetic Light chain variable region CDR L2 nucleic acid sequence
tgggcatctacccgggaatcc

SEQ ID NO: 5087 - protein, 8 aa, Artificial Sequence
  Description of Artificial Sequence: Synthetic Light chain variable region CDR L3 amino acid sequence
KQSYSRRT

SEQ ID NO: 5088 - DNA, 24 bp, Artificial Sequence
  Description of Artificial Sequence: Synthetic Light chain variable region CDR L3 nucleic acid sequence
aagcaatcttattctcggagaact

SEQ ID NO: 5089 - DNA, 357 bp, Artificial Sequence; identical to SEQ ID NO: 4961
  Description of Artificial Sequence: Synthetic Heavy chain variable region nucleic acid sequence

SEQ ID NO: 5090 - protein, 119 aa, Artificial Sequence; identical to SEQ ID NO: 4962
  Description of Artificial Sequence: Synthetic Heavy chain variable region amino acid sequence

SEQ ID NO: 5091 - protein, 9 aa, Artificial Sequence
  Description of Artificial Sequence: Synthetic Heavy chain variable region CDR H1 amino acid sequence
FNIKDYYMH

SEQ ID NO: 5092 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5093 - protein, 17 aa, Artificial Sequence
  Description of Artificial Sequence: Synthetic Heavy chain variable region CDR H2 amino acid sequence
WIDLENGNTIYDPKFQG

SEQ ID NO: 5094 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5095 - protein, 12 aa, Artificial Sequence
  Description of Artificial Sequence: Synthetic Heavy chain variable region CDR H3 amino acid sequence
ARDGYGRYFYDV

SEQ ID NO: 5096 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5097 - DNA, 336 bp, Artificial Sequence; identical to SEQ ID NO: 4969
  Description of Artificial Sequence: Synthetic Light chain variable region nucleic acid sequence

SEQ ID NO: 5098 - protein, 112 aa, Artificial Sequence; identical to SEQ ID NO: 4970
  Description of Artificial Sequence: Synthetic Light chain variable region amino acid sequence

SEQ ID NO: 5099 - protein, 17 aa, Artificial Sequence
  Description of Artificial Sequence: Synthetic Light chain variable region CDR L1 amino acid sequence
KSSQSLLNSRTGKNYLA

SEQ ID NO: 5100 - DNA, 51 bp, Artificial Sequence; identical to SEQ ID NO: 3868
  Description of Artificial Sequence: Synthetic Light chain variable region CDR L1 nucleic acid sequence

SEQ ID NO: 5101 - protein, 7 aa, Artificial Sequence
  Description of Artificial Sequence: Synthetic Light chain variable region CDR L2 amino acid sequence
WASTRES

SEQ ID NO: 5102 - DNA, 21 bp, Artificial Sequence
  Description of Artificial Sequence: Synthetic Light chain variable region CDR L2 nucleic acid sequence
tgggcatctacccgggaatcc

SEQ ID NO: 5103 - protein, 8 aa, Artificial Sequence
  Description of Artificial Sequence: Synthetic Light chain variable region CDR L3 amino acid sequence
KQSYSRRT

SEQ ID NO: 5104 - DNA, 24 bp, Artificial Sequence
  Description of Artificial Sequence: Synthetic Light chain variable region CDR L3 nucleic acid sequence
aagcaatcttattctcggagaact

SEQ ID NO: 5105 - DNA, 357 bp, Artificial Sequence; identical to SEQ ID NO: 4961
  Description of Artificial Sequence: Synthetic Heavy chain variable region nucleic acid sequence

SEQ ID NO: 5106 - protein, 119 aa, Artificial Sequence; identical to SEQ ID NO: 4962
  Description of Artificial Sequence: Synthetic Heavy chain variable region amino acid sequence

SEQ ID NO: 5107 - protein, 9 aa, Artificial Sequence
  Description of Artificial Sequence: Synthetic Heavy chain variable region CDR H1 amino acid sequence
FNIKDYYMH

SEQ ID NO: 5108 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5109 - protein, 17 aa, Artificial Sequence
  Description of Artificial Sequence: Synthetic Heavy chain variable region CDR H2 amino acid sequence
WIDLENGNTIYDPKFQG

SEQ ID NO: 5110 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5111 - protein, 12 aa, Artificial Sequence
  Description of Artificial Sequence: Synthetic Heavy chain variable region CDR H3 amino acid sequence
ARDGYGRYFYDV

SEQ ID NO: 5112 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5113 - DNA, 336 bp, Artificial Sequence; identical to SEQ ID NO: 4969
  Description of Artificial Sequence: Synthetic Light chain variable region nucleic acid sequence

SEQ ID NO: 5114 - protein, 112 aa, Artificial Sequence; identical to SEQ ID NO: 4970
  Description of Artificial Sequence: Synthetic Light chain variable region amino acid sequence

SEQ ID NO: 5115 - protein, 17 aa, Artificial Sequence
  Description of Artificial Sequence: Synthetic Light chain variable region CDR L1 amino acid sequence
KSSQSLLNSRTGKNYLA

SEQ ID NO: 5116 - DNA, 51 bp, Artificial Sequence; identical to SEQ ID NO: 3868
  Description of Artificial Sequence: Synthetic Light chain variable region CDR L1 nucleic acid sequence

SEQ ID NO: 5117 - protein, 7 aa, Artificial Sequence
  Description of Artificial Sequence: Synthetic Light chain variable region CDR L2 amino acid sequence
WASTRES

SEQ ID NO: 5118 - DNA, 21 bp, Artificial Sequence
  Description of Artificial Sequence: Synthetic Light chain variable region CDR L2 nucleic acid sequence
tgggcatctacccgggaatcc

SEQ ID NO: 5119 - protein, 8 aa, Artificial Sequence
  Description of Artificial Sequence: Synthetic Light chain variable region CDR L3 amino acid sequence
KQSYSRRT

SEQ ID NO: 5120 - DNA, 24 bp, Artificial Sequence
  Description of Artificial Sequence: Synthetic Light chain variable region CDR L3 nucleic acid sequence
aagcaatcttattctcggagaact

SEQ ID NO: 5121 - DNA, 357 bp, Artificial Sequence; identical to SEQ ID NO: 4961
  Description of Artificial Sequence: Synthetic Heavy chain variable region nucleic acid sequence

SEQ ID NO: 5122 - protein, 119 aa, Artificial Sequence; identical to SEQ ID NO: 4962
  Description of Artificial Sequence: Synthetic Heavy chain variable region amino acid sequence

SEQ ID NO: 5123 - protein, 9 aa, Artificial Sequence
  Description of Artificial Sequence: Synthetic Heavy chain variable region CDR H1 amino acid sequence
FNIKDYYMH

SEQ ID NO: 5124 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5125 - protein, 17 aa, Artificial Sequence
  Description of Artificial Sequence: Synthetic Heavy chain variable region CDR H2 amino acid sequence
WIDLENGNTIYDPKFQG

SEQ ID NO: 5126 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5127 - protein, 12 aa, Artificial Sequence
  Description of Artificial Sequence: Synthetic Heavy chain variable region CDR H3 amino acid sequence
ARDGYGRYFYDV

SEQ ID NO: 5128 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5129 - DNA, 336 bp, Artificial Sequence; identical to SEQ ID NO: 4969
  Description of Artificial Sequence: Synthetic Light chain variable region nucleic acid sequence

SEQ ID NO: 5130 - protein, 112 aa, Artificial Sequence; identical to SEQ ID NO: 4970
  Description of Artificial Sequence: Synthetic Light chain variable region amino acid sequence

SEQ ID NO: 5131 - protein, 17 aa, Artificial Sequence
  Description of Artificial Sequence: Synthetic Light chain variable region CDR L1 amino acid sequence
KSSQSLLNSRTGKNYLA

SEQ ID NO: 5132 - DNA, 51 bp, Artificial Sequence; identical to SEQ ID NO: 3868
  Description of Artificial Sequence: Synthetic Light chain variable region CDR L1 nucleic acid sequence

SEQ ID NO: 5133 - protein, 7 aa, Artificial Sequence
  Description of Artificial Sequence: Synthetic Light chain variable region CDR L2 amino acid sequence
WASTRES

SEQ ID NO: 5134 - DNA, 21 bp, Artificial Sequence
  Description of Artificial Sequence: Synthetic Light chain variable region CDR L2 nucleic acid sequence
tgggcatctacccgggaatcc

SEQ ID NO: 5135 - protein, 8 aa, Artificial Sequence
  Description of Artificial Sequence: Synthetic Light chain variable region CDR L3 amino acid sequence
KQSYSRRT

SEQ ID NO: 5136 - DNA, 24 bp, Artificial Sequence
  Description of Artificial Sequence: Synthetic Light chain variable region CDR L3 nucleic acid sequence
aagcaatcttattctcggagaact

SEQ ID NO: 5137 - DNA, 357 bp, Artificial Sequence; identical to SEQ ID NO: 4961
  Description of Artificial Sequence: Synthetic Heavy chain variable region nucleic acid sequence

SEQ ID NO: 5138 - protein, 119 aa, Artificial Sequence; identical to SEQ ID NO: 4962
  Description of Artificial Sequence: Synthetic Heavy chain variable region amino acid sequence

SEQ ID NO: 5139 - protein, 9 aa, Artificial Sequence
  Description of Artificial Sequence: Synthetic Heavy chain variable region CDR H1 amino acid sequence
FNIKDYYMH

SEQ ID NO: 5140 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5141 - protein, 17 aa, Artificial Sequence
  Description of Artificial Sequence: Synthetic Heavy chain variable region CDR H2 amino acid sequence
WIDLENGNTIYDPKFQG

SEQ ID NO: 5142 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5143 - protein, 12 aa, Artificial Sequence
  Description of Artificial Sequence: Synthetic Heavy chain variable region CDR H3 amino acid sequence
ARDGYGRYFYDV

SEQ ID NO: 5144 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5145 - DNA, 336 bp, Artificial Sequence; identical to SEQ ID NO: 4969
  Description of Artificial Sequence: Synthetic Light chain variable region nucleic acid sequence

SEQ ID NO: 5146 - protein, 112 aa, Artificial Sequence; identical to SEQ ID NO: 4970
  Description of Artificial Sequence: Synthetic Light chain variable region amino acid sequence

SEQ ID NO: 5147 - protein, 17 aa, Artificial Sequence
  Description of Artificial Sequence: Synthetic Light chain variable region CDR L1 amino acid sequence
KSSQSLLNSRTGKNYLA

SEQ ID NO: 5148 - DNA, 51 bp, Artificial Sequence; identical to SEQ ID NO: 3868
  Description of Artificial Sequence: Synthetic Light chain variable region CDR L1 nucleic acid sequence

SEQ ID NO: 5149 - protein, 7 aa, Artificial Sequence
  Description of Artificial Sequence: Synthetic Light chain variable region CDR L2 amino acid sequence
WASTRES

SEQ ID NO: 5150 - DNA, 21 bp, Artificial Sequence
  Description of Artificial Sequence: Synthetic Light chain variable region CDR L2 nucleic acid sequence
tgggcatctacccgggaatcc

SEQ ID NO: 5151 - protein, 8 aa, Artificial Sequence
  Description of Artificial Sequence: Synthetic Light chain variable region CDR L3 amino acid sequence
KQSYSRRT

SEQ ID NO: 5152 - DNA, 24 bp, Artificial Sequence
  Description of Artificial Sequence: Synthetic Light chain variable region CDR L3 nucleic acid sequence
aagcaatcttattctcggagaact

SEQ ID NO: 5153 - DNA, 357 bp, Artificial Sequence; identical to SEQ ID NO: 4961
  Description of Artificial Sequence: Synthetic Heavy chain variable region nucleic acid sequence

SEQ ID NO: 5154 - protein, 119 aa, Artificial Sequence; identical to SEQ ID NO: 4962
  Description of Artificial Sequence: Synthetic Heavy chain variable region amino acid sequence

SEQ ID NO: 5155 - protein, 9 aa, Artificial Sequence
  Description of Artificial Sequence: Synthetic Heavy chain variable region CDR H1 amino acid sequence
FNIKDYYMH

SEQ ID NO: 5156 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5157 - protein, 17 aa, Artificial Sequence
  Description of Artificial Sequence: Synthetic Heavy chain variable region CDR H2 amino acid sequence
WIDLENGNTIYDPKFQG

SEQ ID NO: 5158 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5159 - protein, 12 aa, Artificial Sequence
  Description of Artificial Sequence: Synthetic Heavy chain variable region CDR H3 amino acid sequence
ARDGYGRYFYDV

SEQ ID NO: 5160 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5161 - DNA, 336 bp, Artificial Sequence; identical to SEQ ID NO: 4969
  Description of Artificial Sequence: Synthetic Light chain variable region nucleic acid sequence

SEQ ID NO: 5162 - protein, 112 aa, Artificial Sequence; identical to SEQ ID NO: 4970
  Description of Artificial Sequence: Synthetic Light chain variable region amino acid sequence

SEQ ID NO: 5163 - protein, 17 aa, Artificial Sequence
  Description of Artificial Sequence: Synthetic Light chain variable region CDR L1 amino acid sequence
KSSQSLLNSRTGKNYLA

SEQ ID NO: 5164 - DNA, 51 bp, Artificial Sequence; identical to SEQ ID NO: 3868
  Description of Artificial Sequence: Synthetic Light chain variable region CDR L1 nucleic acid sequence

SEQ ID NO: 5165 - protein, 7 aa, Artificial Sequence
  Description of Artificial Sequence: Synthetic Light chain variable region CDR L2 amino acid sequence
WASTRES

SEQ ID NO: 5166 - DNA, 21 bp, Artificial Sequence
  Description of Artificial Sequence: Synthetic Light chain variable region CDR L2 nucleic acid sequence
tgggcatctacccgggaatcc

SEQ ID NO: 5167 - protein, 8 aa, Artificial Sequence
  Description of Artificial Sequence: Synthetic Light chain variable region CDR L3 amino acid sequence
KQSYSRRT

SEQ ID NO: 5168 - DNA, 24 bp, Artificial Sequence
  Description of Artificial Sequence: Synthetic Light chain variable region CDR L3 nucleic acid sequence
aagcaatcttattctcggagaact

SEQ ID NO: 5169 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggaggatgtcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgggagatatttttacgacgtgtggggccaaggaaccctggtcaccgtctcctca

SEQ ID NO: 5170 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGGCLEWMGWIDLENGNTIYDPKFQGRVTITRDTSASTAYMELSSLRSEDTAVYYCARDGYGRYFYDVWGQGTLVTVSS

SEQ ID NO: 5171 - protein, 9 aa, Artificial Sequence
  Description of Artificial Sequence: Synthetic Heavy chain variable region CDR H1 amino acid sequence
FNIKDYYMH

SEQ ID NO: 5172 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5173 - protein, 17 aa, Artificial Sequence
  Description of Artificial Sequence: Synthetic Heavy chain variable region CDR H2 amino acid sequence
WIDLENGNTIYDPKFQG

SEQ ID NO: 5174 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5175 - protein, 12 aa, Artificial Sequence
  Description of Artificial Sequence: Synthetic Heavy chain variable region CDR H3 amino acid sequence
ARDGYGRYFYDV

SEQ ID NO: 5176 - DNA, 36 bp, Artificial Sequence; identical to SEQ ID NO: 4168
  Description of Artificial Sequence: Synthetic Heavy chain variable region CDR H3 nucleic acid sequence

SEQ ID NO: 5177 - DNA, 336 bp, Artificial Sequence; identical to SEQ ID NO: 4969
  Description of Artificial Sequence: Synthetic Light chain variable region nucleic acid sequence

SEQ ID NO: 5178 - protein, 112 aa, Artificial Sequence; identical to SEQ ID NO: 4970
  Description of Artificial Sequence: Synthetic Light chain variable region amino acid sequence

SEQ ID NO: 5179 - protein, 17 aa, Artificial Sequence
  Description of Artificial Sequence: Synthetic Light chain variable region CDR L1 amino acid sequence
KSSQSLLNSRTGKNYLA

SEQ ID NO: 5180 - DNA, 51 bp, Artificial Sequence; identical to SEQ ID NO: 3868
  Description of Artificial Sequence: Synthetic Light chain variable region CDR L1 nucleic acid sequence

SEQ ID NO: 5181 - protein, 7 aa, Artificial Sequence
  Description of Artificial Sequence: Synthetic Light chain variable region CDR L2 amino acid sequence
WASTRES

SEQ ID NO: 5182 - DNA, 21 bp, Artificial Sequence
  Description of Artificial Sequence: Synthetic Light chain variable region CDR L2 nucleic acid sequence
tgggcatctacccgggaatcc

SEQ ID NO: 5183 - protein, 8 aa, Artificial Sequence
  Description of Artificial Sequence: Synthetic Light chain variable region CDR L3 amino acid sequence
KQSYSRRT

SEQ ID NO: 5184 - DNA, 24 bp, Artificial Sequence
  Description of Artificial Sequence: Synthetic Light chain variable region CDR L3 nucleic acid sequence
aagcaatcttattctcggagaact

SEQ ID NO: 5185 - DNA, 357 bp, Artificial Sequence; identical to SEQ ID NO: 4705
  Description of Artificial Sequence: Synthetic Heavy chain variable region nucleic acid sequence

SEQ ID NO: 5186 - protein, 119 aa, Artificial Sequence; identical to SEQ ID NO: 4706
  Description of Artificial Sequence: Synthetic Heavy chain variable region amino acid sequence

SEQ ID NO: 5187 - protein, 9 aa, Artificial Sequence
  Description of Artificial Sequence: Synthetic Heavy chain variable region CDR H1 amino acid sequence
FNIKDYYMH

SEQ ID NO: 5188 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5189 - protein, 17 aa, Artificial Sequence
  Description of Artificial Sequence: Synthetic Heavy chain variable region CDR H2 amino acid sequence
WIDLENANTIYDAKFQG

SEQ ID NO: 5190 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5191 - protein, 12 aa, Artificial Sequence
  Description of Artificial Sequence: Synthetic Heavy chain variable region CDR H3 amino acid sequence
ARDAYGRYFYDV

SEQ ID NO: 5192 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 5193 - DNA, 336 bp, Artificial Sequence; identical to SEQ ID NO: 4537
  Description of Artificial Sequence: Synthetic Light chain variable region nucleic acid sequence

SEQ ID NO: 5194 - protein, 112 aa, Artificial Sequence; identical to SEQ ID NO: 4538
  Description of Artificial Sequence: Synthetic Light chain variable region amino acid sequence

SEQ ID NO: 5195 - protein, 17 aa, Artificial Sequence
  Description of Artificial Sequence: Synthetic Light chain variable region CDR L1 amino acid sequence
KSSQSLLNARTGKNYLA

SEQ ID NO: 5196 - DNA, 51 bp, Artificial Sequence; identical to SEQ ID NO: 4540
  Description of Artificial Sequence: Synthetic Light chain variable region CDR L1 nucleic acid sequence

SEQ ID NO: 5197 - protein, 7 aa, Artificial Sequence
  Description of Artificial Sequence: Synthetic Light chain variable region CDR L2 amino acid sequence
WASTRES

SEQ ID NO: 5198 - DNA, 21 bp, Artificial Sequence
  Description of Artificial Sequence: Synthetic Light chain variable region CDR L2 nucleic acid sequence
tgggcatctacccgggaatcc

SEQ ID NO: 5199 - protein, 8 aa, Artificial Sequence
  Description of Artificial Sequence: Synthetic Light chain variable region CDR L3 amino acid sequence
KQSYSRRT

SEQ ID NO: 5200 - DNA, 24 bp, Artificial Sequence
  Description of Artificial Sequence: Synthetic Light chain variable region CDR L3 nucleic acid sequence
aagcaatcttattctcggagaact

SEQ ID NO: 5201 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcggtagagatgcgtacgggagatatttttacgacgtgtggggccaaggaaccctggtcaccgtctcctca

SEQ ID NO: 5202 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCGRDAYGRYFYDVWGQGTLVTVSS

SEQ ID NO: 5203 - protein, 9 aa, Artificial Sequence
  Description of Artificial Sequence: Synthetic Heavy chain variable region CDR H1 amino acid sequence
FNIKDYYMH

SEQ ID NO: 5204 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5205 - protein, 17 aa, Artificial Sequence
  Description of Artificial Sequence: Synthetic Heavy chain variable region CDR H2 amino acid sequence
WIDLENANTIYDAKFQG

SEQ ID NO: 5206 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5207 - protein, 12 aa, Artificial Sequence
  Description of Artificial Sequence: Synthetic Heavy chain variable region CDR H3 amino acid sequence
GRDAYGRYFYDV

SEQ ID NO: 5208 - DNA, 36 bp, Artificial Sequence
  Description of Artificial Sequence: Synthetic Heavy chain variable region CDR H3 nucleic acid sequence
ggtagagatgcgtacgggagatatttttacgacgtg

SEQ ID NO: 5209 - DNA, 336 bp, Artificial Sequence; identical to SEQ ID NO: 4537
  Description of Artificial Sequence: Synthetic Light chain variable region nucleic acid sequence

SEQ ID NO: 5210 - protein, 112 aa, Artificial Sequence; identical to SEQ ID NO: 4538
  Description of Artificial Sequence: Synthetic Light chain variable region amino acid sequence

SEQ ID NO: 5211 - protein, 17 aa, Artificial Sequence
  Description of Artificial Sequence: Synthetic Light chain variable region CDR L1 amino acid sequence
KSSQSLLNARTGKNYLA

SEQ ID NO: 5212 - DNA, 51 bp, Artificial Sequence; identical to SEQ ID NO: 4540
  Description of Artificial Sequence: Synthetic Light chain variable region CDR L1 nucleic acid sequence

SEQ ID NO: 5213 - protein, 7 aa, Artificial Sequence
  Description of Artificial Sequence: Synthetic Light chain variable region CDR L2 amino acid sequence
WASTRES

SEQ ID NO: 5214 - DNA, 21 bp, Artificial Sequence
  Description of Artificial Sequence: Synthetic Light chain variable region CDR L2 nucleic acid sequence
tgggcatctacccgggaatcc

SEQ ID NO: 5215 - protein, 8 aa, Artificial Sequence
  Description of Artificial Sequence: Synthetic Light chain variable region CDR L3 amino acid sequence
KQSYSRRT

SEQ ID NO: 5216 - DNA, 24 bp, Artificial Sequence
  Description of Artificial Sequence: Synthetic Light chain variable region CDR L3 nucleic acid sequence
aagcaatcttattctcggagaact

SEQ ID NO: 5217 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaagagggcaacacaatctatgacgctaagtttcagggcagggtcaccataaccagggacacgtccgccagcacagcctacatggagctgagcagcctgagatctgaagacacggcggtgtactactgcgcgagagatgcttacgggagatatttttacgacgtgtggggccaaggaaccctggtcaccgtctcctca

SEQ ID NO: 5218 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLEEGNTIYDAKFQGRVTITRDTSASTAYMELSSLRSEDTAVYYCARDAYGRYFYDVWGQGTLVTVSS

SEQ ID NO: 5219 - protein, 9 aa, Artificial Sequence
  Description of Artificial Sequence: Synthetic Heavy chain variable region CDR H1 amino acid sequence
FNIKDYYMH

SEQ ID NO: 5220 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5221 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5222 - DNA, 51 bp, Artificial Sequence
  Description of Artificial Sequence: Synthetic Heavy chain variable region CDR H2 nucleic acid sequence
tggatcgaccttgaagagggcaacacaatctatgacgctaagtttcagggc

SEQ ID NO: 5223 - protein, 12 aa, Artificial Sequence
  Description of Artificial Sequence: Synthetic Heavy chain variable region CDR H3 amino acid sequence
ARDAYGRYFYDV

SEQ ID NO: 5224 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 5225 - DNA, 336 bp, Artificial Sequence; identical to SEQ ID NO: 4537
  Description of Artificial Sequence: Synthetic Light chain variable region nucleic acid sequence

SEQ ID NO: 5226 - protein, 112 aa, Artificial Sequence; identical to SEQ ID NO: 4538
  Description of Artificial Sequence: Synthetic Light chain variable region amino acid sequence

SEQ ID NO: 5227 - protein, 17 aa, Artificial Sequence
  Description of Artificial Sequence: Synthetic Light chain variable region CDR L1 amino acid sequence
KSSQSLLNARTGKNYLA

SEQ ID NO: 5228 - DNA, 51 bp, Artificial Sequence; identical to SEQ ID NO: 4540
  Description of Artificial Sequence: Synthetic Light chain variable region CDR L1 nucleic acid sequence

SEQ ID NO: 5229 - protein, 7 aa, Artificial Sequence
  Description of Artificial Sequence: Synthetic Light chain variable region CDR L2 amino acid sequence
WASTRES

SEQ ID NO: 5230 - DNA, 21 bp, Artificial Sequence
  Description of Artificial Sequence: Synthetic Light chain variable region CDR L2 nucleic acid sequence
tgggcatctacccgggaatcc

SEQ ID NO: 5231 - protein, 8 aa, Artificial Sequence
  Description of Artificial Sequence: Synthetic Light chain variable region CDR L3 amino acid sequence
KQSYSRRT

SEQ ID NO: 5232 - DNA, 24 bp, Artificial Sequence
  Description of Artificial Sequence: Synthetic Light chain variable region CDR L3 nucleic acid sequence
aagcaatcttattctcggagaact

SEQ ID NO: 5233 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaagagggcaacacaatctatgacgctaagtttcagggcagggtcaccataaccagggacacgtccgccagcacagcctacatggagctgagcagcctgagatctgaagacacggcggtgtactactgcggtagagatgcgtacgggagatatttttacgacgtgtggggccaaggaaccctggtcaccgtctcctca

SEQ ID NO: 5234 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLEEGNTIYDAKFQGRVTITRDTSASTAYMELSSLRSEDTAVYYCGRDAYGRYFYDVWGQGTLVTVSS

SEQ ID NO: 5235 - protein, 9 aa, Artificial Sequence
  Description of Artificial Sequence: Synthetic Heavy chain variable region CDR H1 amino acid sequence
FNIKDYYMH

SEQ ID NO: 5236 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5237 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5238 - DNA, 51 bp, Artificial Sequence; identical to SEQ ID NO: 5222
  Description of Artificial Sequence: Synthetic Heavy chain variable region CDR H2 nucleic acid sequence

SEQ ID NO: 5239 - protein, 12 aa, Artificial Sequence
  Description of Artificial Sequence: Synthetic Heavy chain variable region CDR H3 amino acid sequence
GRDAYGRYFYDV

SEQ ID NO: 5240 - DNA, 36 bp, Artificial Sequence; identical to SEQ ID NO: 5208
  Description of Artificial Sequence: Synthetic Heavy chain variable region CDR H3 nucleic acid sequence

SEQ ID NO: 5241 - DNA, 336 bp, Artificial Sequence; identical to SEQ ID NO: 4537
  Description of Artificial Sequence: Synthetic Light chain variable region nucleic acid sequence

SEQ ID NO: 5242 - protein, 112 aa, Artificial Sequence; identical to SEQ ID NO: 4538
  Description of Artificial Sequence: Synthetic Light chain variable region amino acid sequence

SEQ ID NO: 5243 - protein, 17 aa, Artificial Sequence
  Description of Artificial Sequence: Synthetic Light chain variable region CDR L1 amino acid sequence
KSSQSLLNARTGKNYLA

SEQ ID NO: 5244 - DNA, 51 bp, Artificial Sequence; identical to SEQ ID NO: 4540
  Description of Artificial Sequence: Synthetic Light chain variable region CDR L1 nucleic acid sequence

SEQ ID NO: 5245 - protein, 7 aa, Artificial Sequence
  Description of Artificial Sequence: Synthetic Light chain variable region CDR L2 amino acid sequence
WASTRES

SEQ ID NO: 5246 - DNA, 21 bp, Artificial Sequence
  Description of Artificial Sequence: Synthetic Light chain variable region CDR L2 nucleic acid sequence
tgggcatctacccgggaatcc

SEQ ID NO: 5247 - protein, 8 aa, Artificial Sequence
  Description of Artificial Sequence: Synthetic Light chain variable region CDR L3 amino acid sequence
KQSYSRRT

SEQ ID NO: 5248 - DNA, 24 bp, Artificial Sequence
  Description of Artificial Sequence: Synthetic Light chain variable region CDR L3 nucleic acid sequence
aagcaatcttattctcggagaact

SEQ ID NO: 5249 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatcgttacggggcttatttttacgacgtgtggggccaaggaaccctggtcaccgtctcctca

SEQ ID NO: 5250 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDRYGAYFYDVWGQGTLVTVSS

SEQ ID NO: 5251 - protein, 9 aa, Artificial Sequence
  Description of Artificial Sequence: Synthetic Heavy chain variable region CDR H1 amino acid sequence
FNIKDYYMH

SEQ ID NO: 5252 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5253 - protein, 17 aa, Artificial Sequence
  Description of Artificial Sequence: Synthetic Heavy chain variable region CDR H2 amino acid sequence
WIDLENANTIYDAKFQG

SEQ ID NO: 5254 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5255 - protein, 12 aa, Artificial Sequence
  Description of Artificial Sequence: Synthetic Heavy chain variable region CDR H3 amino acid sequence
ARDRYGAYFYDV

SEQ ID NO: 5256 - DNA, 36 bp, Artificial Sequence
  Description of Artificial Sequence: Synthetic Heavy chain variable region CDR H3 nucleic acid sequence
gcgagagatcgttacggggcttatttttacgacgtg

SEQ ID NO: 5257 - DNA, 336 bp, Artificial Sequence; identical to SEQ ID NO: 4537
  Description of Artificial Sequence: Synthetic Light chain variable region nucleic acid sequence

SEQ ID NO: 5258 - protein, 112 aa, Artificial Sequence; identical to SEQ ID NO: 4538
  Description of Artificial Sequence: Synthetic Light chain variable region amino acid sequence

SEQ ID NO: 5259 - protein, 17 aa, Artificial Sequence
  Description of Artificial Sequence: Synthetic Light chain variable region CDR L1 amino acid sequence
KSSQSLLNARTGKNYLA

SEQ ID NO: 5260 - DNA, 51 bp, Artificial Sequence; identical to SEQ ID NO: 4540
  Description of Artificial Sequence: Synthetic Light chain variable region CDR L1 nucleic acid sequence

SEQ ID NO: 5261 - protein, 7 aa, Artificial Sequence
  Description of Artificial Sequence: Synthetic Light chain variable region CDR L2 amino acid sequence
WASTRES

SEQ ID NO: 5262 - DNA, 21 bp, Artificial Sequence
  Description of Artificial Sequence: Synthetic Light chain variable region CDR L2 nucleic acid sequence
tgggcatctacccgggaatcc

SEQ ID NO: 5263 - protein, 8 aa, Artificial Sequence
  Description of Artificial Sequence: Synthetic Light chain variable region CDR L3 amino acid sequence
KQSYSRRT

SEQ ID NO: 5264 - DNA, 24 bp, Artificial Sequence
  Description of Artificial Sequence: Synthetic Light chain variable region CDR L3 nucleic acid sequence
aagcaatcttattctcggagaact

SEQ ID NO: 5265 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatgtgttggggagatatttttacgacgtgtggggccaaggaaccctggtcaccgtctcctca

SEQ ID NO: 5266 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDVLGRYFYDVWGQGTLVTVSS

SEQ ID NO: 5267 - protein, 9 aa, Artificial Sequence
  Description of Artificial Sequence: Synthetic Heavy chain variable region CDR H1 amino acid sequence
FNIKDYYMH

SEQ ID NO: 5268 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5269 - protein, 17 aa, Artificial Sequence
  Description of Artificial Sequence: Synthetic Heavy chain variable region CDR H2 amino acid sequence
WIDLENANTIYDAKFQG

SEQ ID NO: 5270 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5271 - protein, 12 aa, Artificial Sequence
  Description of Artificial Sequence: Synthetic Heavy chain variable region CDR H3 amino acid sequence
ARDVLGRYFYDV

SEQ ID NO: 5272 - DNA, 36 bp, Artificial Sequence
  Description of Artificial Sequence: Synthetic Heavy chain variable region CDR H3 nucleic acid sequence
gcgagagatgtgttggggagatatttttacgacgtg

SEQ ID NO: 5273 - DNA, 336 bp, Artificial Sequence; identical to SEQ ID NO: 4537
  Description of Artificial Sequence: Synthetic Light chain variable region nucleic acid sequence

SEQ ID NO: 5274 - protein, 112 aa, Artificial Sequence; identical to SEQ ID NO: 4538
  Description of Artificial Sequence: Synthetic Light chain variable region amino acid sequence

SEQ ID NO: 5275 - protein, 17 aa, Artificial Sequence
  Description of Artificial Sequence: Synthetic Light chain variable region CDR L1 amino acid sequence
KSSQSLLNARTGKNYLA

SEQ ID NO: 5276 - DNA, 51 bp, Artificial Sequence; identical to SEQ ID NO: 4540
  Description of Artificial Sequence: Synthetic Light chain variable region CDR L1 nucleic acid sequence

SEQ ID NO: 5277 - protein, 7 aa, Artificial Sequence
  Description of Artificial Sequence: Synthetic Light chain variable region CDR L2 amino acid sequence
WASTRES

SEQ ID NO: 5278 - DNA, 21 bp, Artificial Sequence
  Description of Artificial Sequence: Synthetic Light chain variable region CDR L2 nucleic acid sequence
tgggcatctacccgggaatcc

SEQ ID NO: 5279 - protein, 8 aa, Artificial Sequence
  Description of Artificial Sequence: Synthetic Light chain variable region CDR L3 amino acid sequence
KQSYSRRT

SEQ ID NO: 5280 - DNA, 24 bp, Artificial Sequence
  Description of Artificial Sequence: Synthetic Light chain variable region CDR L3 nucleic acid sequence
aagcaatcttattctcggagaact

SEQ ID NO: 5281 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatcagtacgggagatatttttacgacgtgtggggccaaggaaccctggtcaccgtctcctca

SEQ ID NO: 5282 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDQYGRYFYDVWGQGTLVTVSS

SEQ ID NO: 5283 - protein, 9 aa, Artificial Sequence
  Description of Artificial Sequence: Synthetic Heavy chain variable region CDR H1 amino acid sequence
FNIKDYYMH

SEQ ID NO: 5284 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5285 - protein, 17 aa, Artificial Sequence
  Description of Artificial Sequence: Synthetic Heavy chain variable region CDR H2 amino acid sequence
WIDLENANTIYDAKFQG

SEQ ID NO: 5286 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5287 - protein, 12 aa, Artificial Sequence
  Description of Artificial Sequence: Synthetic Heavy chain variable region CDR H3 amino acid sequence
ARDQYGRYFYDV

SEQ ID NO: 5288 - DNA, 36 bp, Artificial Sequence
  Description of Artificial Sequence: Synthetic Heavy chain variable region CDR H3 nucleic acid sequence
gcgagagatcagtacgggagatatttttacgacgtg

SEQ ID NO: 5289 - DNA, 336 bp, Artificial Sequence; identical to SEQ ID NO: 4537
  Description of Artificial Sequence: Synthetic Light chain variable region nucleic acid sequence

SEQ ID NO: 5290 - protein, 112 aa, Artificial Sequence; identical to SEQ ID NO: 4538
  Description of Artificial Sequence: Synthetic Light chain variable region amino acid sequence

SEQ ID NO: 5291 - protein, 17 aa, Artificial Sequence
  Description of Artificial Sequence: Synthetic Light chain variable region CDR L1 amino acid sequence
KSSQSLLNARTGKNYLA

SEQ ID NO: 5292 - DNA, 51 bp, Artificial Sequence; identical to SEQ ID NO: 4540
  Description of Artificial Sequence: Synthetic Light chain variable region CDR L1 nucleic acid sequence

SEQ ID NO: 5293 - protein, 7 aa, Artificial Sequence
  Description of Artificial Sequence: Synthetic Light chain variable region CDR L2 amino acid sequence
WASTRES

SEQ ID NO: 5294 - DNA, 21 bp, Artificial Sequence
  Description of Artificial Sequence: Synthetic Light chain variable region CDR L2 nucleic acid sequence
tgggcatctacccgggaatcc

SEQ ID NO: 5295 - protein, 8 aa, Artificial Sequence
  Description of Artificial Sequence: Synthetic Light chain variable region CDR L3 amino acid sequence
KQSYSRRT

SEQ ID NO: 5296 - DNA, 24 bp, Artificial Sequence
  Description of Artificial Sequence: Synthetic Light chain variable region CDR L3 nucleic acid sequence
aagcaatcttattctcggagaact

SEQ ID NO: 5297 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaagagggcaacacaatctatgacgctaagtttcagggcagggtcaccataaccagggacacgtccgccagcacagcctacatggagctgagcagcctgagatctgaagacacggcggtgtactactgcgcgagagatgtgttggggagatatttttacgacgtgtggggccaaggaaccctggtcaccgtctcctca

SEQ ID NO: 5298 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLEEGNTIYDAKFQGRVTITRDTSASTAYMELSSLRSEDTAVYYCARDVLGRYFYDVWGQGTLVTVSS

SEQ ID NO: 5299 - protein, 9 aa, Artificial Sequence
  Description of Artificial Sequence: Synthetic Heavy chain variable region CDR H1 amino acid sequence
FNIKDYYMH

SEQ ID NO: 5300 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5301 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5302 - DNA, 51 bp, Artificial Sequence; identical to SEQ ID NO: 5222
  Description of Artificial Sequence: Synthetic Heavy chain variable region CDR H2 nucleic acid sequence

SEQ ID NO: 5303 - protein, 12 aa, Artificial Sequence
  Description of Artificial Sequence: Synthetic Heavy chain variable region CDR H3 amino acid sequence
ARDVLGRYFYDV

SEQ ID NO: 5304 - DNA, 36 bp, Artificial Sequence; identical to SEQ ID NO: 5272
  Description of Artificial Sequence: Synthetic Heavy chain variable region CDR H3 nucleic acid sequence

SEQ ID NO: 5305 - DNA, 336 bp, Artificial Sequence; identical to SEQ ID NO: 4537
  Description of Artificial Sequence: Synthetic Light chain variable region nucleic acid sequence

SEQ ID NO: 5306 - protein, 112 aa, Artificial Sequence; identical to SEQ ID NO: 4538
  Description of Artificial Sequence: Synthetic Light chain variable region amino acid sequence

SEQ ID NO: 5307 - protein, 17 aa, Artificial Sequence
  Description of Artificial Sequence: Synthetic Light chain variable region CDR L1 amino acid sequence
KSSQSLLNARTGKNYLA

SEQ ID NO: 5308 - DNA, 51 bp, Artificial Sequence; identical to SEQ ID NO: 4540
  Description of Artificial Sequence: Synthetic Light chain variable region CDR L1 nucleic acid sequence

SEQ ID NO: 5309 - protein, 7 aa, Artificial Sequence
  Description of Artificial Sequence: Synthetic Light chain variable region CDR L2 amino acid sequence
WASTRES

SEQ ID NO: 5310 - DNA, 21 bp, Artificial Sequence
  Description of Artificial Sequence: Synthetic Light chain variable region CDR L2 nucleic acid sequence
tgggcatctacccgggaatcc

SEQ ID NO: 5311 - protein, 8 aa, Artificial Sequence
  Description of Artificial Sequence: Synthetic Light chain variable region CDR L3 amino acid sequence
KQSYSRRT

SEQ ID NO: 5312 - DNA, 24 bp, Artificial Sequence
  Description of Artificial Sequence: Synthetic Light chain variable region CDR L3 nucleic acid sequence
aagcaatcttattctcggagaact

SEQ ID NO: 5313 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatgtgtacgggagatatttttacgacctttggggccaaggaaccctggtcaccgtctcctca

SEQ ID NO: 5314 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDVYGRYFYDLWGQGTLVTVSS

SEQ ID NO: 5315 - protein, 9 aa, Artificial Sequence
  Description of Artificial Sequence: Synthetic Heavy chain variable region CDR H1 amino acid sequence
FNIKDYYMH

SEQ ID NO: 5316 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5317 - protein, 17 aa, Artificial Sequence
  Description of Artificial Sequence: Synthetic Heavy chain variable region CDR H2 amino acid sequence
WIDLENANTIYDAKFQG

SEQ ID NO: 5318 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5319 - protein, 12 aa, Artificial Sequence
  Description of Artificial Sequence: Synthetic Heavy chain variable region CDR H3 amino acid sequence
ARDVYGRYFYDL

SEQ ID NO: 5320 - DNA, 36 bp, Artificial Sequence
  Description of Artificial Sequence: Synthetic Heavy chain variable region CDR H3 nucleic acid sequence
gcgagagatgtgtacgggagatatttttacgacctt

SEQ ID NO: 5321 - DNA, 336 bp, Artificial Sequence; identical to SEQ ID NO: 4537
  Description of Artificial Sequence: Synthetic Light chain variable region nucleic acid sequence

SEQ ID NO: 5322 - protein, 112 aa, Artificial Sequence; identical to SEQ ID NO: 4538
  Description of Artificial Sequence: Synthetic Light chain variable region amino acid sequence

SEQ ID NO: 5323 - protein, 17 aa, Artificial Sequence
  Description of Artificial Sequence: Synthetic Light chain variable region CDR L1 amino acid sequence
KSSQSLLNARTGKNYLA

SEQ ID NO: 5324 - DNA, 51 bp, Artificial Sequence; identical to SEQ ID NO: 4540
  Description of Artificial Sequence: Synthetic Light chain variable region CDR L1 nucleic acid sequence

SEQ ID NO: 5325 - protein, 7 aa, Artificial Sequence
  Description of Artificial Sequence: Synthetic Light chain variable region CDR L2 amino acid sequence
WASTRES

SEQ ID NO: 5326 - DNA, 21 bp, Artificial Sequence
  Description of Artificial Sequence: Synthetic Light chain variable region CDR L2 nucleic acid sequence
tgggcatctacccgggaatcc

SEQ ID NO: 5327 - protein, 8 aa, Artificial Sequence
  Description of Artificial Sequence: Synthetic Light chain variable region CDR L3 amino acid sequence
KQSYSRRT

SEQ ID NO: 5328 - DNA, 24 bp, Artificial Sequence
  Description of Artificial Sequence: Synthetic Light chain variable region CDR L3 nucleic acid sequence
aagcaatcttattctcggagaact

SEQ ID NO: 5329 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatgcgtacggggggtatttttacgacgtgtggggccaaggaaccctggtcaccgtctcctca

SEQ ID NO: 5330 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDAYGGYFYDVWGQGTLVTVSS

SEQ ID NO: 5331 - protein, 9 aa, Artificial Sequence
  Description of Artificial Sequence: Synthetic Heavy chain variable region CDR H1 amino acid sequence
FNIKDYYMH

SEQ ID NO: 5332 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5333 - protein, 17 aa, Artificial Sequence
  Description of Artificial Sequence: Synthetic Heavy chain variable region CDR H2 amino acid sequence
WIDLENANTIYDAKFQG

SEQ ID NO: 5334 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5335 - protein, 12 aa, Artificial Sequence
  Description of Artificial Sequence: Synthetic Heavy chain variable region CDR H3 amino acid sequence
ARDAYGGYFYDV

SEQ ID NO: 5336 - DNA, 36 bp, Artificial Sequence
  Description of Artificial Sequence: Synthetic Heavy chain variable region CDR H3 nucleic acid sequence
gcgagagatgcgtacggggggtatttttacgacgtg

SEQ ID NO: 5337 - DNA, 336 bp, Artificial Sequence; identical to SEQ ID NO: 4537
  Description of Artificial Sequence: Synthetic Light chain variable region nucleic acid sequence

SEQ ID NO: 5338 - protein, 112 aa, Artificial Sequence; identical to SEQ ID NO: 4538
  Description of Artificial Sequence: Synthetic Light chain variable region amino acid sequence

SEQ ID NO: 5339 - protein, 17 aa, Artificial Sequence
  Description of Artificial Sequence: Synthetic Light chain variable region CDR L1 amino acid sequence
KSSQSLLNARTGKNYLA

SEQ ID NO: 5340 - DNA, 51 bp, Artificial Sequence; identical to SEQ ID NO: 4540
  Description of Artificial Sequence: Synthetic Light chain variable region CDR L1 nucleic acid sequence

SEQ ID NO: 5341 - protein, 7 aa, Artificial Sequence
  Description of Artificial Sequence: Synthetic Light chain variable region CDR L2 amino acid sequence
WASTRES

SEQ ID NO: 5342 - DNA, 21 bp, Artificial Sequence
  Description of Artificial Sequence: Synthetic Light chain variable region CDR L2 nucleic acid sequence
tgggcatctacccgggaatcc

SEQ ID NO: 5343 - protein, 8 aa, Artificial Sequence
  Description of Artificial Sequence: Synthetic Light chain variable region CDR L3 amino acid sequence
KQSYSRRT

SEQ ID NO: 5344 - DNA, 24 bp, Artificial Sequence
  Description of Artificial Sequence: Synthetic Light chain variable region CDR L3 nucleic acid sequence
aagcaatcttattctcggagaact

SEQ ID NO: 5345 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagataattacggggggtatttttacgacgtgtggggccaaggaaccctggtcaccgtctcctca

SEQ ID NO: 5346 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDNYGGYFYDVWGQGTLVTVSS

SEQ ID NO: 5347 - protein, 9 aa, Artificial Sequence
  Description of Artificial Sequence: Synthetic Heavy chain variable region CDR H1 amino acid sequence
FNIKDYYMH

SEQ ID NO: 5348 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5349 - protein, 17 aa, Artificial Sequence
  Description of Artificial Sequence: Synthetic Heavy chain variable region CDR H2 amino acid sequence
WIDLENANTIYDAKFQG

SEQ ID NO: 5350 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5351 - protein, 12 aa, Artificial Sequence
  Description of Artificial Sequence: Synthetic Heavy chain variable region CDR H3 amino acid sequence
ARDNYGGYFYDV

SEQ ID NO: 5352 - DNA, 36 bp, Artificial Sequence
  Description of Artificial Sequence: Synthetic Heavy chain variable region CDR H3 nucleic acid sequence
gcgagagataattacggggggtatttttacgacgtg

SEQ ID NO: 5353 - DNA, 336 bp, Artificial Sequence; identical to SEQ ID NO: 4537
  Description of Artificial Sequence: Synthetic Light chain variable region nucleic acid sequence

SEQ ID NO: 5354 - protein, 112 aa, Artificial Sequence; identical to SEQ ID NO: 4538
  Description of Artificial Sequence: Synthetic Light chain variable region amino acid sequence

SEQ ID NO: 5355 - protein, 17 aa, Artificial Sequence
  Description of Artificial Sequence: Synthetic Light chain variable region CDR L1 amino acid sequence
KSSQSLLNARTGKNYLA

SEQ ID NO: 5356 - DNA, 51 bp, Artificial Sequence; identical to SEQ ID NO: 4540
  Description of Artificial Sequence: Synthetic Light chain variable region CDR L1 nucleic acid sequence

SEQ ID NO: 5357 - protein, 7 aa, Artificial Sequence
  Description of Artificial Sequence: Synthetic Light chain variable region CDR L2 amino acid sequence
WASTRES

SEQ ID NO: 5358 - DNA, 21 bp, Artificial Sequence
  Description of Artificial Sequence: Synthetic Light chain variable region CDR L2 nucleic acid sequence
tgggcatctacccgggaatcc

SEQ ID NO: 5359 - protein, 8 aa, Artificial Sequence
  Description of Artificial Sequence: Synthetic Light chain variable region CDR L3 amino acid sequence
KQSYSRRT

SEQ ID NO: 5360 - DNA, 24 bp, Artificial Sequence
  Description of Artificial Sequence: Synthetic Light chain variable region CDR L3 nucleic acid sequence
aagcaatcttattctcggagaact

SEQ ID NO: 5361 - DNA, 357 bp, Artificial Sequence; identical to SEQ ID NO: 4705
  Description of Artificial Sequence: Synthetic Heavy chain variable region nucleic acid sequence

SEQ ID NO: 5362 - protein, 119 aa, Artificial Sequence; identical to SEQ ID NO: 4706
  Description of Artificial Sequence: Synthetic Heavy chain variable region amino acid sequence

SEQ ID NO: 5363 - protein, 9 aa, Artificial Sequence
  Description of Artificial Sequence: Synthetic Heavy chain variable region CDR H1 amino acid sequence
FNIKDYYMH

SEQ ID NO: 5364 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5365 - protein, 17 aa, Artificial Sequence
  Description of Artificial Sequence: Synthetic Heavy chain variable region CDR H2 amino acid sequence
WIDLENANTIYDAKFQG

SEQ ID NO: 5366 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5367 - protein, 12 aa, Artificial Sequence
  Description of Artificial Sequence: Synthetic Heavy chain variable region CDR H3 amino acid sequence
ARDAYGRYFYDV

SEQ ID NO: 5368 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 5369 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacgctagaaccggaaagaactacttagcttggtaccagcagaaaccaggacagcctcctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctctgagaactttcggcggagggaccaaggtcgagatcaaa

SEQ ID NO: 5370 - protein, 112 aa, Artificial Sequence
  Description of Artificial Sequence: Synthetic Light chain variable region amino acid sequence
DIVMTQSPDSLAVSLGERATINCKSSQSLLNARTGKNYLAWYQQKPGQPPKLLIYWASTRESGVPDRFSGSGSGTDFTLTISSLQAEDVAVYYCKQSYSLRTFGGGTKVEIK

SEQ ID NO: 5371 - protein, 17 aa, Artificial Sequence
  Description of Artificial Sequence: Synthetic Light chain variable region CDR L1 amino acid sequence
KSSQSLLNARTGKNYLA

SEQ ID NO: 5372 - DNA, 51 bp, Artificial Sequence; identical to SEQ ID NO: 4540
  Description of Artificial Sequence: Synthetic Light chain variable region CDR L1 nucleic acid sequence

SEQ ID NO: 5373 - protein, 7 aa, Artificial Sequence
  Description of Artificial Sequence: Synthetic Light chain variable region CDR L2 amino acid sequence
WASTRES

SEQ ID NO: 5374 - DNA, 21 bp, Artificial Sequence
  Description of Artificial Sequence: Synthetic Light chain variable region CDR L2 nucleic acid sequence
tgggcatctacccgggaatcc

SEQ ID NO: 5375 - protein, 8 aa, Artificial Sequence
  Description of Artificial Sequence: Synthetic Light chain variable region CDR L3 amino acid sequence
KQSYSLRT

SEQ ID NO: 5376 - DNA, 24 bp, Artificial Sequence
  Description of Artificial Sequence: Synthetic Light chain variable region CDR L3 nucleic acid sequence
aagcaatcttattctctgagaact

SEQ ID NO: 5377 - DNA, 357 bp, Artificial Sequence; identical to SEQ ID NO: 5201
  Description of Artificial Sequence: Synthetic Heavy chain variable region nucleic acid sequence

SEQ ID NO: 5378 - protein, 119 aa, Artificial Sequence; identical to SEQ ID NO: 5202
  Description of Artificial Sequence: Synthetic Heavy chain variable region amino acid sequence

SEQ ID NO: 5379 - protein, 9 aa, Artificial Sequence
  Description of Artificial Sequence: Synthetic Heavy chain variable region CDR H1 amino acid sequence
FNIKDYYMH

SEQ ID NO: 5380 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5381 - protein, 17 aa, Artificial Sequence
  Description of Artificial Sequence: Synthetic Heavy chain variable region CDR H2 amino acid sequence
WIDLENANTIYDAKFQG

SEQ ID NO: 5382 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5383 - protein, 12 aa, Artificial Sequence
  Description of Artificial Sequence: Synthetic Heavy chain variable region CDR H3 amino acid sequence
GRDAYGRYFYDV

SEQ ID NO: 5384 - DNA, 36 bp, Artificial Sequence; identical to SEQ ID NO: 5208
  Description of Artificial Sequence: Synthetic Heavy chain variable region CDR H3 nucleic acid sequence

SEQ ID NO: 5385 - DNA, 336 bp, Artificial Sequence; identical to SEQ ID NO: 5369
  Description of Artificial Sequence: Synthetic Light chain variable region nucleic acid sequence

SEQ ID NO: 5386 - protein, 112 aa, Artificial Sequence; identical to SEQ ID NO: 5370
  Description of Artificial Sequence: Synthetic Light chain variable region amino acid sequence

SEQ ID NO: 5387 - protein, 17 aa, Artificial Sequence
  Description of Artificial Sequence: Synthetic Light chain variable region CDR L1 amino acid sequence
KSSQSLLNARTGKNYLA

SEQ ID NO: 5388 - DNA, 51 bp, Artificial Sequence; identical to SEQ ID NO: 4540
  Description of Artificial Sequence: Synthetic Light chain variable region CDR L1 nucleic acid sequence

SEQ ID NO: 5389 - protein, 7 aa, Artificial Sequence
  Description of Artificial Sequence: Synthetic Light chain variable region CDR L2 amino acid sequence
WASTRES

SEQ ID NO: 5390 - DNA, 21 bp, Artificial Sequence
  Description of Artificial Sequence: Synthetic Light chain variable region CDR L2 nucleic acid sequence
tgggcatctacccgggaatcc

SEQ ID NO: 5391 - protein, 8 aa, Artificial Sequence
  Description of Artificial Sequence: Synthetic Light chain variable region CDR L3 amino acid sequence
KQSYSLRT

SEQ ID NO: 5392 - DNA, 24 bp, Artificial Sequence
  Description of Artificial Sequence: Synthetic Light chain variable region CDR L3 nucleic acid sequence
aagcaatcttattctctgagaact

SEQ ID NO: 5393 - DNA, 357 bp, Artificial Sequence; identical to SEQ ID NO: 5217
  Description of Artificial Sequence: Synthetic Heavy chain variable region nucleic acid sequence

SEQ ID NO: 5394 - protein, 119 aa, Artificial Sequence; identical to SEQ ID NO: 5218
  Description of Artificial Sequence: Synthetic Heavy chain variable region amino acid sequence

SEQ ID NO: 5395 - protein, 9 aa, Artificial Sequence
  Description of Artificial Sequence: Synthetic Heavy chain variable region CDR H1 amino acid sequence
FNIKDYYMH

SEQ ID NO: 5396 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5397 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5398 - DNA, 51 bp, Artificial Sequence; identical to SEQ ID NO: 5222
  Description of Artificial Sequence: Synthetic Heavy chain variable region CDR H2 nucleic acid sequence

SEQ ID NO: 5399 - protein, 12 aa, Artificial Sequence
  Description of Artificial Sequence: Synthetic Heavy chain variable region CDR H3 amino acid sequence
ARDAYGRYFYDV

SEQ ID NO: 5400 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 5401 - DNA, 336 bp, Artificial Sequence; identical to SEQ ID NO: 5369
  Description of Artificial Sequence: Synthetic Light chain variable region nucleic acid sequence

SEQ ID NO: 5402 - protein, 112 aa, Artificial Sequence; identical to SEQ ID NO: 5370
  Description of Artificial Sequence: Synthetic Light chain variable region amino acid sequence

SEQ ID NO: 5403 - protein, 17 aa, Artificial Sequence
  Description of Artificial Sequence: Synthetic Light chain variable region CDR L1 amino acid sequence
KSSQSLLNARTGKNYLA

SEQ ID NO: 5404 - DNA, 51 bp, Artificial Sequence; identical to SEQ ID NO: 4540
  Description of Artificial Sequence: Synthetic Light chain variable region CDR L1 nucleic acid sequence

SEQ ID NO: 5405 - protein, 7 aa, Artificial Sequence
  Description of Artificial Sequence: Synthetic Light chain variable region CDR L2 amino acid sequence
WASTRES

SEQ ID NO: 5406 - DNA, 21 bp, Artificial Sequence
  Description of Artificial Sequence: Synthetic Light chain variable region CDR L2 nucleic acid sequence
tgggcatctacccgggaatcc

SEQ ID NO: 5407 - protein, 8 aa, Artificial Sequence
  Description of Artificial Sequence: Synthetic Light chain variable region CDR L3 amino acid sequence
KQSYSLRT

SEQ ID NO: 5408 - DNA, 24 bp, Artificial Sequence
  Description of Artificial Sequence: Synthetic Light chain variable region CDR L3 nucleic acid sequence
aagcaatcttattctctgagaact

SEQ ID NO: 5409 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcggtagagatgcgtacgggctgtatttttacgacgtgtggggccaaggaaccctggtcaccgtctcctca

SEQ ID NO: 5410 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCGRDAYGLYFYDVWGQGTLVTVSS

SEQ ID NO: 5411 - protein, 9 aa, Artificial Sequence
  Description of Artificial Sequence: Synthetic Heavy chain variable region CDR H1 amino acid sequence
FNIKDYYMH

SEQ ID NO: 5412 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5413 - protein, 17 aa, Artificial Sequence
  Description of Artificial Sequence: Synthetic Heavy chain variable region CDR H2 amino acid sequence
WIDLENANTIYDAKFQG

SEQ ID NO: 5414 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5415 - protein, 12 aa, Artificial Sequence
  Description of Artificial Sequence: Synthetic Heavy chain variable region CDR H3 amino acid sequence
GRDAYGLYFYDV

SEQ ID NO: 5416 - DNA, 36 bp, Artificial Sequence
  Description of Artificial Sequence: Synthetic Heavy chain variable region CDR H3 nucleic acid sequence
ggtagagatgcgtacgggctgtatttttacgacgtg

SEQ ID NO: 5417 - DNA, 336 bp, Artificial Sequence; identical to SEQ ID NO: 5369
  Description of Artificial Sequence: Synthetic Light chain variable region nucleic acid sequence

SEQ ID NO: 5418 - protein, 112 aa, Artificial Sequence; identical to SEQ ID NO: 5370
  Description of Artificial Sequence: Synthetic Light chain variable region amino acid sequence

SEQ ID NO: 5419 - protein, 17 aa, Artificial Sequence
  Description of Artificial Sequence: Synthetic Light chain variable region CDR L1 amino acid sequence
KSSQSLLNARTGKNYLA

SEQ ID NO: 5420 - DNA, 51 bp, Artificial Sequence; identical to SEQ ID NO: 4540
  Description of Artificial Sequence: Synthetic Light chain variable region CDR L1 nucleic acid sequence

SEQ ID NO: 5421 - protein, 7 aa, Artificial Sequence
  Description of Artificial Sequence: Synthetic Light chain variable region CDR L2 amino acid sequence
WASTRES

SEQ ID NO: 5422 - DNA, 21 bp, Artificial Sequence
  Description of Artificial Sequence: Synthetic Light chain variable region CDR L2 nucleic acid sequence
tgggcatctacccgggaatcc

SEQ ID NO: 5423 - protein, 8 aa, Artificial Sequence
  Description of Artificial Sequence: Synthetic Light chain variable region CDR L3 amino acid sequence
KQSYSLRT

SEQ ID NO: 5424 - DNA, 24 bp, Artificial Sequence
  Description of Artificial Sequence: Synthetic Light chain variable region CDR L3 nucleic acid sequence
aagcaatcttattctctgagaact

SEQ ID NO: 5425 - DNA, 357 bp, Artificial Sequence; identical to SEQ ID NO: 5265
  Description of Artificial Sequence: Synthetic Heavy chain variable region nucleic acid sequence

SEQ ID NO: 5426 - protein, 119 aa, Artificial Sequence; identical to SEQ ID NO: 5266
  Description of Artificial Sequence: Synthetic Heavy chain variable region amino acid sequence

SEQ ID NO: 5427 - protein, 9 aa, Artificial Sequence
  Description of Artificial Sequence: Synthetic Heavy chain variable region CDR H1 amino acid sequence
FNIKDYYMH

SEQ ID NO: 5428 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5429 - protein, 17 aa, Artificial Sequence
  Description of Artificial Sequence: Synthetic Heavy chain variable region CDR H2 amino acid sequence
WIDLENANTIYDAKFQG

SEQ ID NO: 5430 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5431 - protein, 12 aa, Artificial Sequence
  Description of Artificial Sequence: Synthetic Heavy chain variable region CDR H3 amino acid sequence
ARDVLGRYFYDV

SEQ ID NO: 5432 - DNA, 36 bp, Artificial Sequence; identical to SEQ ID NO: 5272
  Description of Artificial Sequence: Synthetic Heavy chain variable region CDR H3 nucleic acid sequence

SEQ ID NO: 5433 - DNA, 336 bp, Artificial Sequence; identical to SEQ ID NO: 5369
  Description of Artificial Sequence: Synthetic Light chain variable region nucleic acid sequence

SEQ ID NO: 5434 - protein, 112 aa, Artificial Sequence; identical to SEQ ID NO: 5370
  Description of Artificial Sequence: Synthetic Light chain variable region amino acid sequence

SEQ ID NO: 5435 - protein, 17 aa, Artificial Sequence
  Description of Artificial Sequence: Synthetic Light chain variable region CDR L1 amino acid sequence
KSSQSLLNARTGKNYLA

SEQ ID NO: 5436 - DNA, 51 bp, Artificial Sequence; identical to SEQ ID NO: 4540
  Description of Artificial Sequence: Synthetic Light chain variable region CDR L1 nucleic acid sequence

SEQ ID NO: 5437 - protein, 7 aa, Artificial Sequence
  Description of Artificial Sequence: Synthetic Light chain variable region CDR L2 amino acid sequence
WASTRES

SEQ ID NO: 5438 - DNA, 21 bp, Artificial Sequence
  Description of Artificial Sequence: Synthetic Light chain variable region CDR L2 nucleic acid sequence
tgggcatctacccgggaatcc

SEQ ID NO: 5439 - protein, 8 aa, Artificial Sequence
  Description of Artificial Sequence: Synthetic Light chain variable region CDR L3 amino acid sequence
KQSYSLRT

SEQ ID NO: 5440 - DNA, 24 bp, Artificial Sequence
  Description of Artificial Sequence: Synthetic Light chain variable region CDR L3 nucleic acid sequence
aagcaatcttattctctgagaact

SEQ ID NO: 5441 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaagagggcaacacaatctatgacgctaagtttcagggcagggtcaccataaccagggacacgtccgccagcacagcctacatggagctgagcagcctgagatctgaagacacggcggtgtactactgcgcgagagatcgttacggggcttatttttacgacgtgtggggccaaggaaccctggtcaccgtctcctca

SEQ ID NO: 5442 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLEEGNTIYDAKFQGRVTITRDTSASTAYMELSSLRSEDTAVYYCARDRYGAYFYDVWGQGTLVTVSS

SEQ ID NO: 5443 - protein, 9 aa, Artificial Sequence
  Description of Artificial Sequence: Synthetic Heavy chain variable region CDR H1 amino acid sequence
FNIKDYYMH

SEQ ID NO: 5444 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5445 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5446 - DNA, 51 bp, Artificial Sequence; identical to SEQ ID NO: 5222
  Description of Artificial Sequence: Synthetic Heavy chain variable region CDR H2 nucleic acid sequence

SEQ ID NO: 5447 - protein, 12 aa, Artificial Sequence
  Description of Artificial Sequence: Synthetic Heavy chain variable region CDR H3 amino acid sequence
ARDRYGAYFYDV

SEQ ID NO: 5448 - DNA, 36 bp, Artificial Sequence; identical to SEQ ID NO: 5256
  Description of Artificial Sequence: Synthetic Heavy chain variable region CDR H3 nucleic acid sequence

SEQ ID NO: 5449 - DNA, 336 bp, Artificial Sequence; identical to SEQ ID NO: 5369
  Description of Artificial Sequence: Synthetic Light chain variable region nucleic acid sequence

SEQ ID NO: 5450 - protein, 112 aa, Artificial Sequence; identical to SEQ ID NO: 5370
  Description of Artificial Sequence: Synthetic Light chain variable region amino acid sequence

SEQ ID NO: 5451 - protein, 17 aa, Artificial Sequence
  Description of Artificial Sequence: Synthetic Light chain variable region CDR L1 amino acid sequence
KSSQSLLNARTGKNYLA

SEQ ID NO: 5452 - DNA, 51 bp, Artificial Sequence; identical to SEQ ID NO: 4540
  Description of Artificial Sequence: Synthetic Light chain variable region CDR L1 nucleic acid sequence

SEQ ID NO: 5453 - protein, 7 aa, Artificial Sequence
  Description of Artificial Sequence: Synthetic Light chain variable region CDR L2 amino acid sequence
WASTRES

SEQ ID NO: 5454 - DNA, 21 bp, Artificial Sequence
  Description of Artificial Sequence: Synthetic Light chain variable region CDR L2 nucleic acid sequence
tgggcatctacccgggaatcc

SEQ ID NO: 5455 - protein, 8 aa, Artificial Sequence
  Description of Artificial Sequence: Synthetic Light chain variable region CDR L3 amino acid sequence
KQSYSLRT

SEQ ID NO: 5456 - DNA, 24 bp, Artificial Sequence
  Description of Artificial Sequence: Synthetic Light chain variable region CDR L3 nucleic acid sequence
aagcaatcttattctctgagaact

SEQ ID NO: 5457 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaagagggcaacacaatctatgacgctaagtttcagggcagggtcaccataaccagggacacgtccgccagcacagcctacatggagctgagcagcctgagatctgaagacacggcggtgtactactgcggtagagatgcgtacgggctgtatttttacgacgtgtggggccaaggaaccctggtcaccgtctcctca

SEQ ID NO: 5458 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLEEGNTIYDAKFQGRVTITRDTSASTAYMELSSLRSEDTAVYYCGRDAYGLYFYDVWGQGTLVTVSS

SEQ ID NO: 5459 - protein, 9 aa, Artificial Sequence
  Description of Artificial Sequence: Synthetic Heavy chain variable region CDR H1 amino acid sequence
FNIKDYYMH

SEQ ID NO: 5460 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5461 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5462 - DNA, 51 bp, Artificial Sequence; identical to SEQ ID NO: 5222
  Description of Artificial Sequence: Synthetic Heavy chain variable region CDR H2 nucleic acid sequence

SEQ ID NO: 5463 - protein, 12 aa, Artificial Sequence
  Description of Artificial Sequence: Synthetic Heavy chain variable region CDR H3 amino acid sequence
GRDAYGLYFYDV

SEQ ID NO: 5464 - DNA, 36 bp, Artificial Sequence; identical to SEQ ID NO: 5416
  Description of Artificial Sequence: Synthetic Heavy chain variable region CDR H3 nucleic acid sequence

SEQ ID NO: 5465 - DNA, 336 bp, Artificial Sequence; identical to SEQ ID NO: 5369
  Description of Artificial Sequence: Synthetic Light chain variable region nucleic acid sequence

SEQ ID NO: 5466 - protein, 112 aa, Artificial Sequence; identical to SEQ ID NO: 5370
  Description of Artificial Sequence: Synthetic Light chain variable region amino acid sequence

SEQ ID NO: 5467 - protein, 17 aa, Artificial Sequence
  Description of Artificial Sequence: Synthetic Light chain variable region CDR L1 amino acid sequence
KSSQSLLNARTGKNYLA

SEQ ID NO: 5468 - DNA, 51 bp, Artificial Sequence; identical to SEQ ID NO: 4540
  Description of Artificial Sequence: Synthetic Light chain variable region CDR L1 nucleic acid sequence

SEQ ID NO: 5469 - protein, 7 aa, Artificial Sequence
  Description of Artificial Sequence: Synthetic Light chain variable region CDR L2 amino acid sequence
WASTRES

SEQ ID NO: 5470 - DNA, 21 bp, Artificial Sequence
  Description of Artificial Sequence: Synthetic Light chain variable region CDR L2 nucleic acid sequence
tgggcatctacccgggaatcc

SEQ ID NO: 5471 - protein, 8 aa, Artificial Sequence
  Description of Artificial Sequence: Synthetic Light chain variable region CDR L3 amino acid sequence
KQSYSLRT

SEQ ID NO: 5472 - DNA, 24 bp, Artificial Sequence
  Description of Artificial Sequence: Synthetic Light chain variable region CDR L3 nucleic acid sequence
aagcaatcttattctctgagaact

SEQ ID NO: 5473 - DNA, 357 bp, Artificial Sequence; identical to SEQ ID NO: 5297
  Description of Artificial Sequence: Synthetic Heavy chain variable region nucleic acid sequence

SEQ ID NO: 5474 - protein, 119 aa, Artificial Sequence; identical to SEQ ID NO: 5298
  Description of Artificial Sequence: Synthetic Heavy chain variable region amino acid sequence

SEQ ID NO: 5475 - protein, 9 aa, Artificial Sequence
  Description of Artificial Sequence: Synthetic Heavy chain variable region CDR H1 amino acid sequence
FNIKDYYMH

SEQ ID NO: 5476 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5477 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5478 - DNA, 51 bp, Artificial Sequence; identical to SEQ ID NO: 5222
  Description of Artificial Sequence: Synthetic Heavy chain variable region CDR H2 nucleic acid sequence

SEQ ID NO: 5479 - protein, 12 aa, Artificial Sequence
  Description of Artificial Sequence: Synthetic Heavy chain variable region CDR H3 amino acid sequence
ARDVLGRYFYDV

SEQ ID NO: 5480 - DNA, 36 bp, Artificial Sequence; identical to SEQ ID NO: 5272
  Description of Artificial Sequence: Synthetic Heavy chain variable region CDR H3 nucleic acid sequence

SEQ ID NO: 5481 - DNA, 336 bp, Artificial Sequence; identical to SEQ ID NO: 5369
  Description of Artificial Sequence: Synthetic Light chain variable region nucleic acid sequence

SEQ ID NO: 5482 - protein, 112 aa, Artificial Sequence; identical to SEQ ID NO: 5370
  Description of Artificial Sequence: Synthetic Light chain variable region amino acid sequence

SEQ ID NO: 5483 - protein, 17 aa, Artificial Sequence
  Description of Artificial Sequence: Synthetic Light chain variable region CDR L1 amino acid sequence
KSSQSLLNARTGKNYLA

SEQ ID NO: 5484 - DNA, 51 bp, Artificial Sequence; identical to SEQ ID NO: 4540
  Description of Artificial Sequence: Synthetic Light chain variable region CDR L1 nucleic acid sequence

SEQ ID NO: 5485 - protein, 7 aa, Artificial Sequence
  Description of Artificial Sequence: Synthetic Light chain variable region CDR L2 amino acid sequence
WASTRES

SEQ ID NO: 5486 - DNA, 21 bp, Artificial Sequence
  Description of Artificial Sequence: Synthetic Light chain variable region CDR L2 nucleic acid sequence
tgggcatctacccgggaatcc

SEQ ID NO: 5487 - protein, 8 aa, Artificial Sequence
  Description of Artificial Sequence: Synthetic Light chain variable region CDR L3 amino acid sequence
KQSYSLRT

SEQ ID NO: 5488 - DNA, 24 bp, Artificial Sequence
  Description of Artificial Sequence: Synthetic Light chain variable region CDR L3 nucleic acid sequence
aagcaatcttattctctgagaact

SEQ ID NO: 5489 - DNA, 357 bp, Artificial Sequence; identical to SEQ ID NO: 5313
  Description of Artificial Sequence: Synthetic Heavy chain variable region nucleic acid sequence

SEQ ID NO: 5490 - protein, 119 aa, Artificial Sequence; identical to SEQ ID NO: 5314
  Description of Artificial Sequence: Synthetic Heavy chain variable region amino acid sequence

SEQ ID NO: 5491 - protein, 9 aa, Artificial Sequence
  Description of Artificial Sequence: Synthetic Heavy chain variable region CDR H1 amino acid sequence
FNIKDYYMH

SEQ ID NO: 5492 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5493 - protein, 17 aa, Artificial Sequence
  Description of Artificial Sequence: Synthetic Heavy chain variable region CDR H2 amino acid sequence
WIDLENANTIYDAKFQG

SEQ ID NO: 5494 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5495 - protein, 12 aa, Artificial Sequence
  Description of Artificial Sequence: Synthetic Heavy chain variable region CDR H3 amino acid sequence
ARDVYGRYFYDL

SEQ ID NO: 5496 - DNA, 36 bp, Artificial Sequence; identical to SEQ ID NO: 5320
  Description of Artificial Sequence: Synthetic Heavy chain variable region CDR H3 nucleic acid sequence

SEQ ID NO: 5497 - DNA, 336 bp, Artificial Sequence; identical to SEQ ID NO: 5369
  Description of Artificial Sequence: Synthetic Light chain variable region nucleic acid sequence

SEQ ID NO: 5498 - protein, 112 aa, Artificial Sequence; identical to SEQ ID NO: 5370
  Description of Artificial Sequence: Synthetic Light chain variable region amino acid sequence

SEQ ID NO: 5499 - protein, 17 aa, Artificial Sequence
  Description of Artificial Sequence: Synthetic Light chain variable region CDR L1 amino acid sequence
KSSQSLLNARTGKNYLA

SEQ ID NO: 5500 - DNA, 51 bp, Artificial Sequence; identical to SEQ ID NO: 4540
  Description of Artificial Sequence: Synthetic Light chain variable region CDR L1 nucleic acid sequence

SEQ ID NO: 5501 - protein, 7 aa, Artificial Sequence
  Description of Artificial Sequence: Synthetic Light chain variable region CDR L2 amino acid sequence
WASTRES

SEQ ID NO: 5502 - DNA, 21 bp, Artificial Sequence
  Description of Artificial Sequence: Synthetic Light chain variable region CDR L2 nucleic acid sequence
tgggcatctacccgggaatcc

SEQ ID NO: 5503 - protein, 8 aa, Artificial Sequence
  Description of Artificial Sequence: Synthetic Light chain variable region CDR L3 amino acid sequence
KQSYSLRT

SEQ ID NO: 5504 - DNA, 24 bp, Artificial Sequence
  Description of Artificial Sequence: Synthetic Light chain variable region CDR L3 nucleic acid sequence
aagcaatcttattctctgagaact

SEQ ID NO: 5505 - DNA, 357 bp, Artificial Sequence; identical to SEQ ID NO: 5345
  Description of Artificial Sequence: Synthetic Heavy chain variable region nucleic acid sequence

SEQ ID NO: 5506 - protein, 119 aa, Artificial Sequence; identical to SEQ ID NO: 5346
  Description of Artificial Sequence: Synthetic Heavy chain variable region amino acid sequence

SEQ ID NO: 5507 - protein, 9 aa, Artificial Sequence
  Description of Artificial Sequence: Synthetic Heavy chain variable region CDR H1 amino acid sequence
FNIKDYYMH

SEQ ID NO: 5508 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5509 - protein, 17 aa, Artificial Sequence
  Description of Artificial Sequence: Synthetic Heavy chain variable region CDR H2 amino acid sequence
WIDLENANTIYDAKFQG

SEQ ID NO: 5510 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5511 - protein, 12 aa, Artificial Sequence
  Description of Artificial Sequence: Synthetic Heavy chain variable region CDR H3 amino acid sequence
ARDNYGGYFYDV

SEQ ID NO: 5512 - DNA, 36 bp, Artificial Sequence; identical to SEQ ID NO: 5352
  Description of Artificial Sequence: Synthetic Heavy chain variable region CDR H3 nucleic acid sequence

SEQ ID NO: 5513 - DNA, 336 bp, Artificial Sequence; identical to SEQ ID NO: 5369
  Description of Artificial Sequence: Synthetic Light chain variable region nucleic acid sequence

SEQ ID NO: 5514 - protein, 112 aa, Artificial Sequence; identical to SEQ ID NO: 5370
  Description of Artificial Sequence: Synthetic Light chain variable region amino acid sequence

SEQ ID NO: 5515 - protein, 17 aa, Artificial Sequence
  Description of Artificial Sequence: Synthetic Light chain variable region CDR L1 amino acid sequence
KSSQSLLNARTGKNYLA

SEQ ID NO: 5516 - DNA, 51 bp, Artificial Sequence; identical to SEQ ID NO: 4540
  Description of Artificial Sequence: Synthetic Light chain variable region CDR L1 nucleic acid sequence

SEQ ID NO: 5517 - protein, 7 aa, Artificial Sequence
  Description of Artificial Sequence: Synthetic Light chain variable region CDR L2 amino acid sequence
WASTRES

SEQ ID NO: 5518 - DNA, 21 bp, Artificial Sequence
  Description of Artificial Sequence: Synthetic Light chain variable region CDR L2 nucleic acid sequence
tgggcatctacccgggaatcc

SEQ ID NO: 5519 - protein, 8 aa, Artificial Sequence
  Description of Artificial Sequence: Synthetic Light chain variable region CDR L3 amino acid sequence
KQSYSLRT

SEQ ID NO: 5520 - DNA, 24 bp, Artificial Sequence
  Description of Artificial Sequence: Synthetic Light chain variable region CDR L3 nucleic acid sequence
aagcaatcttattctctgagaact

SEQ ID NO: 5521 - DNA, 357 bp, Artificial Sequence; identical to SEQ ID NO: 4705
  Description of Artificial Sequence: Synthetic Heavy chain variable region nucleic acid sequence

SEQ ID NO: 5522 - protein, 119 aa, Artificial Sequence; identical to SEQ ID NO: 4706
  Description of Artificial Sequence: Synthetic Heavy chain variable region amino acid sequence

SEQ ID NO: 5523 - protein, 9 aa, Artificial Sequence
  Description of Artificial Sequence: Synthetic Heavy chain variable region CDR H1 amino acid sequence
FNIKDYYMH

SEQ ID NO: 5524 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5525 - protein, 17 aa, Artificial Sequence
  Description of Artificial Sequence: Synthetic Heavy chain variable region CDR H2 amino acid sequence
WIDLENANTIYDAKFQG

SEQ ID NO: 5526 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5527 - protein, 12 aa, Artificial Sequence
  Description of Artificial Sequence: Synthetic Heavy chain variable region CDR H3 amino acid sequence
ARDAYGRYFYDV

SEQ ID NO: 5528 - DNA, 36 bp, Artificial Sequence; identical to SEQ ID NO: 4568
  Description of Artificial Sequence: Synthetic Heavy chain variable region CDR H3 nucleic acid sequence

SEQ ID NO: 5529 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacgctagaaccggaaagaactacttagcttggtaccagcagaaaccaggacagcctcctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctatcagaactttcggcggagggaccaaggtcgagatcaaa

SEQ ID NO: 5530 - protein, 112 aa, Artificial Sequence
  Description of Artificial Sequence: Synthetic Light chain variable region amino acid sequence
DIVMTQSPDSLAVSLGERATINCKSSQSLLNARTGKNYLAWYQQKPGQPPKLLIYWASTRESGVPDRFSGSGSGTDFTLTISSLQAEDVAVYYCKQSYSIRTFGGGTKVEIK

SEQ ID NO: 5531 - protein, 17 aa, Artificial Sequence
  Description of Artificial Sequence: Synthetic Light chain variable region CDR L1 amino acid sequence
KSSQSLLNARTGKNYLA

SEQ ID NO: 5532 - DNA, 51 bp, Artificial Sequence; identical to SEQ ID NO: 4540
  Description of Artificial Sequence: Synthetic Light chain variable region CDR L1 nucleic acid sequence

SEQ ID NO: 5533 - protein, 7 aa, Artificial Sequence
  Description of Artificial Sequence: Synthetic Light chain variable region CDR L2 amino acid sequence
WASTRES

SEQ ID NO: 5534 - DNA, 21 bp, Artificial Sequence
  Description of Artificial Sequence: Synthetic Light chain variable region CDR L2 nucleic acid sequence
tgggcatctacccgggaatcc

SEQ ID NO: 5535 - protein, 8 aa, Artificial Sequence
  Description of Artificial Sequence: Synthetic Light chain variable region CDR L3 amino acid sequence
KQSYSIRT

SEQ ID NO: 5536 - DNA, 24 bp, Artificial Sequence
  Description of Artificial Sequence: Synthetic Light chain variable region CDR L3 nucleic acid sequence
aagcaatcttattctatcagaact

SEQ ID NO: 5537 - DNA, 357 bp, Artificial Sequence; identical to SEQ ID NO: 5265
  Description of Artificial Sequence: Synthetic Heavy chain variable region nucleic acid sequence

SEQ ID NO: 5538 - protein, 119 aa, Artificial Sequence; identical to SEQ ID NO: 5266
  Description of Artificial Sequence: Synthetic Heavy chain variable region amino acid sequence

SEQ ID NO: 5539 - protein, 9 aa, Artificial Sequence
  Description of Artificial Sequence: Synthetic Heavy chain variable region CDR H1 amino acid sequence
FNIKDYYMH

SEQ ID NO: 5540 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5541 - protein, 17 aa, Artificial Sequence
  Description of Artificial Sequence: Synthetic Heavy chain variable region CDR H2 amino acid sequence
WIDLENANTIYDAKFQG

SEQ ID NO: 5542 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5543 - protein, 12 aa, Artificial Sequence
  Description of Artificial Sequence: Synthetic Heavy chain variable region CDR H3 amino acid sequence
ARDVLGRYFYDV

SEQ ID NO: 5544 - DNA, 36 bp, Artificial Sequence; identical to SEQ ID NO: 5272
  Description of Artificial Sequence: Synthetic Heavy chain variable region CDR H3 nucleic acid sequence

SEQ ID NO: 5545 - DNA, 336 bp, Artificial Sequence; identical to SEQ ID NO: 5529
  Description of Artificial Sequence: Synthetic Light chain variable region nucleic acid sequence

SEQ ID NO: 5546 - protein, 112 aa, Artificial Sequence; identical to SEQ ID NO: 5530
  Description of Artificial Sequence: Synthetic Light chain variable region amino acid sequence

SEQ ID NO: 5547 - protein, 17 aa, Artificial Sequence
  Description of Artificial Sequence: Synthetic Light chain variable region CDR L1 amino acid sequence
KSSQSLLNARTGKNYLA

SEQ ID NO: 5548 - DNA, 51 bp, Artificial Sequence; identical to SEQ ID NO: 4540
  Description of Artificial Sequence: Synthetic Light chain variable region CDR L1 nucleic acid sequence

SEQ ID NO: 5549 - protein, 7 aa, Artificial Sequence
  Description of Artificial Sequence: Synthetic Light chain variable region CDR L2 amino acid sequence
WASTRES

SEQ ID NO: 5550 - DNA, 21 bp, Artificial Sequence
  Description of Artificial Sequence: Synthetic Light chain variable region CDR L2 nucleic acid sequence
tgggcatctacccgggaatcc

SEQ ID NO: 5551 - protein, 8 aa, Artificial Sequence
  Description of Artificial Sequence: Synthetic Light chain variable region CDR L3 amino acid sequence
KQSYSIRT

SEQ ID NO: 5552 - DNA, 24 bp, Artificial Sequence
  Description of Artificial Sequence: Synthetic Light chain variable region CDR L3 nucleic acid sequence
aagcaatcttattctatcagaact

SEQ ID NO: 5553 - DNA, 357 bp, Artificial Sequence; identical to SEQ ID NO: 5281
  Description of Artificial Sequence: Synthetic Heavy chain variable region nucleic acid sequence

SEQ ID NO: 5554 - protein, 119 aa, Artificial Sequence; identical to SEQ ID NO: 5282
  Description of Artificial Sequence: Synthetic Heavy chain variable region amino acid sequence

SEQ ID NO: 5555 - protein, 9 aa, Artificial Sequence
  Description of Artificial Sequence: Synthetic Heavy chain variable region CDR H1 amino acid sequence
FNIKDYYMH

SEQ ID NO: 5556 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5557 - protein, 17 aa, Artificial Sequence
  Description of Artificial Sequence: Synthetic Heavy chain variable region CDR H2 amino acid sequence
WIDLENANTIYDAKFQG

SEQ ID NO: 5558 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5559 - protein, 12 aa, Artificial Sequence
  Description of Artificial Sequence: Synthetic Heavy chain variable region CDR H3 amino acid sequence
ARDQYGRYFYDV

SEQ ID NO: 5560 - DNA, 36 bp, Artificial Sequence; identical to SEQ ID NO: 5288
  Description of Artificial Sequence: Synthetic Heavy chain variable region CDR H3 nucleic acid sequence

SEQ ID NO: 5561 - DNA, 336 bp, Artificial Sequence; identical to SEQ ID NO: 5529
  Description of Artificial Sequence: Synthetic Light chain variable region nucleic acid sequence

SEQ ID NO: 5562 - protein, 112 aa, Artificial Sequence; identical to SEQ ID NO: 5530
  Description of Artificial Sequence: Synthetic Light chain variable region amino acid sequence

SEQ ID NO: 5563 - protein, 17 aa, Artificial Sequence
  Description of Artificial Sequence: Synthetic Light chain variable region CDR L1 amino acid sequence
KSSQSLLNARTGKNYLA

SEQ ID NO: 5564 - DNA, 51 bp, Artificial Sequence; identical to SEQ ID NO: 4540
  Description of Artificial Sequence: Synthetic Light chain variable region CDR L1 nucleic acid sequence

SEQ ID NO: 5565 - protein, 7 aa, Artificial Sequence
  Description of Artificial Sequence: Synthetic Light chain variable region CDR L2 amino acid sequence
WASTRES

SEQ ID NO: 5566 - DNA, 21 bp, Artificial Sequence
  Description of Artificial Sequence: Synthetic Light chain variable region CDR L2 nucleic acid sequence
tgggcatctacccgggaatcc

SEQ ID NO: 5567 - protein, 8 aa, Artificial Sequence
  Description of Artificial Sequence: Synthetic Light chain variable region CDR L3 amino acid sequence
KQSYSIRT

SEQ ID NO: 5568 - DNA, 24 bp, Artificial Sequence
  Description of Artificial Sequence: Synthetic Light chain variable region CDR L3 nucleic acid sequence
aagcaatcttattctatcagaact

SEQ ID NO: 5569 - DNA, 357 bp, Artificial Sequence; identical to SEQ ID NO: 5441
  Description of Artificial Sequence: Synthetic Heavy chain variable region nucleic acid sequence

SEQ ID NO: 5570 - protein, 119 aa, Artificial Sequence; identical to SEQ ID NO: 5442
  Description of Artificial Sequence: Synthetic Heavy chain variable region amino acid sequence

SEQ ID NO: 5571 - protein, 9 aa, Artificial Sequence
  Description of Artificial Sequence: Synthetic Heavy chain variable region CDR H1 amino acid sequence
FNIKDYYMH

SEQ ID NO: 5572 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5573 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5574 - DNA, 51 bp, Artificial Sequence; identical to SEQ ID NO: 5222
  Description of Artificial Sequence: Synthetic Heavy chain variable region CDR H2 nucleic acid sequence

SEQ ID NO: 5575 - protein, 12 aa, Artificial Sequence
  Description of Artificial Sequence: Synthetic Heavy chain variable region CDR H3 amino acid sequence
ARDRYGAYFYDV

SEQ ID NO: 5576 - DNA, 36 bp, Artificial Sequence; identical to SEQ ID NO: 5256
  Description of Artificial Sequence: Synthetic Heavy chain variable region CDR H3 nucleic acid sequence

SEQ ID NO: 5577 - DNA, 336 bp, Artificial Sequence; identical to SEQ ID NO: 5529
  Description of Artificial Sequence: Synthetic Light chain variable region nucleic acid sequence

SEQ ID NO: 5578 - protein, 112 aa, Artificial Sequence; identical to SEQ ID NO: 5530
  Description of Artificial Sequence: Synthetic Light chain variable region amino acid sequence

SEQ ID NO: 5579 - protein, 17 aa, Artificial Sequence
  Description of Artificial Sequence: Synthetic Light chain variable region CDR L1 amino acid sequence
KSSQSLLNARTGKNYLA

SEQ ID NO: 5580 - DNA, 51 bp, Artificial Sequence; identical to SEQ ID NO: 4540
  Description of Artificial Sequence: Synthetic Light chain variable region CDR L1 nucleic acid sequence

SEQ ID NO: 5581 - protein, 7 aa, Artificial Sequence
  Description of Artificial Sequence: Synthetic Light chain variable region CDR L2 amino acid sequence
WASTRES

SEQ ID NO: 5582 - DNA, 21 bp, Artificial Sequence
  Description of Artificial Sequence: Synthetic Light chain variable region CDR L2 nucleic acid sequence
tgggcatctacccgggaatcc

SEQ ID NO: 5583 - protein, 8 aa, Artificial Sequence
  Description of Artificial Sequence: Synthetic Light chain variable region CDR L3 amino acid sequence
KQSYSIRT

SEQ ID NO: 5584 - DNA, 24 bp, Artificial Sequence
  Description of Artificial Sequence: Synthetic Light chain variable region CDR L3 nucleic acid sequence
aagcaatcttattctatcagaact

SEQ ID NO: 5585 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaagagggcaacacaatctatgacgctaagtttcagggcagggtcaccataaccagggacacgtccgccagcacagcctacatggagctgagcagcctgagatctgaagacacggcggtgtactactgcgcgagagatcagtacgggagatatttttacgacgtgtggggccaaggaaccctggtcaccgtctcctca

SEQ ID NO: 5586 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLEEGNTIYDAKFQGRVTITRDTSASTAYMELSSLRSEDTAVYYCARDQYGRYFYDVWGQGTLVTVSS

SEQ ID NO: 5587 - protein, 9 aa, Artificial Sequence
  Description of Artificial Sequence: Synthetic Heavy chain variable region CDR H1 amino acid sequence
FNIKDYYMH

SEQ ID NO: 5588 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5589 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5590 - DNA, 51 bp, Artificial Sequence; identical to SEQ ID NO: 5222
  Description of Artificial Sequence: Synthetic Heavy chain variable region CDR H2 nucleic acid sequence

SEQ ID NO: 5591 - protein, 12 aa, Artificial Sequence
  Description of Artificial Sequence: Synthetic Heavy chain variable region CDR H3 amino acid sequence
ARDQYGRYFYDV

SEQ ID NO: 5592 - DNA, 36 bp, Artificial Sequence; identical to SEQ ID NO: 5288
  Description of Artificial Sequence: Synthetic Heavy chain variable region CDR H3 nucleic acid sequence

SEQ ID NO: 5593 - DNA, 336 bp, Artificial Sequence; identical to SEQ ID NO: 5529
  Description of Artificial Sequence: Synthetic Light chain variable region nucleic acid sequence

SEQ ID NO: 5594 - protein, 112 aa, Artificial Sequence; identical to SEQ ID NO: 5530
  Description of Artificial Sequence: Synthetic Light chain variable region amino acid sequence

SEQ ID NO: 5595 - protein, 17 aa, Artificial Sequence
  Description of Artificial Sequence: Synthetic Light chain variable region CDR L1 amino acid sequence
KSSQSLLNARTGKNYLA

SEQ ID NO: 5596 - DNA, 51 bp, Artificial Sequence; identical to SEQ ID NO: 4540
  Description of Artificial Sequence: Synthetic Light chain variable region CDR L1 nucleic acid sequence

SEQ ID NO: 5597 - protein, 7 aa, Artificial Sequence
  Description of Artificial Sequence: Synthetic Light chain variable region CDR L2 amino acid sequence
WASTRES

SEQ ID NO: 5598 - DNA, 21 bp, Artificial Sequence
  Description of Artificial Sequence: Synthetic Light chain variable region CDR L2 nucleic acid sequence
tgggcatctacccgggaatcc

SEQ ID NO: 5599 - protein, 8 aa, Artificial Sequence
  Description of Artificial Sequence: Synthetic Light chain variable region CDR L3 amino acid sequence
KQSYSIRT

SEQ ID NO: 5600 - DNA, 24 bp, Artificial Sequence
  Description of Artificial Sequence: Synthetic Light chain variable region CDR L3 nucleic acid sequence
aagcaatcttattctatcagaact

SEQ ID NO: 5601 - DNA, 357 bp, Artificial Sequence; identical to SEQ ID NO: 5313
  Description of Artificial Sequence: Synthetic Heavy chain variable region nucleic acid sequence

SEQ ID NO: 5602 - protein, 119 aa, Artificial Sequence; identical to SEQ ID NO: 5314
  Description of Artificial Sequence: Synthetic Heavy chain variable region amino acid sequence

SEQ ID NO: 5603 - protein, 9 aa, Artificial Sequence
  Description of Artificial Sequence: Synthetic Heavy chain variable region CDR H1 amino acid sequence
FNIKDYYMH

SEQ ID NO: 5604 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5605 - protein, 17 aa, Artificial Sequence
  Description of Artificial Sequence: Synthetic Heavy chain variable region CDR H2 amino acid sequence
WIDLENANTIYDAKFQG

SEQ ID NO: 5606 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5607 - protein, 12 aa, Artificial Sequence
  Description of Artificial Sequence: Synthetic Heavy chain variable region CDR H3 amino acid sequence
ARDVYGRYFYDL

SEQ ID NO: 5608 - DNA, 36 bp, Artificial Sequence; identical to SEQ ID NO: 5320
  Description of Artificial Sequence: Synthetic Heavy chain variable region CDR H3 nucleic acid sequence

SEQ ID NO: 5609 - DNA, 336 bp, Artificial Sequence; identical to SEQ ID NO: 5529
  Description of Artificial Sequence: Synthetic Light chain variable region nucleic acid sequence

SEQ ID NO: 5610 - protein, 112 aa, Artificial Sequence; identical to SEQ ID NO: 5530
  Description of Artificial Sequence: Synthetic Light chain variable region amino acid sequence

SEQ ID NO: 5611 - protein, 17 aa, Artificial Sequence
  Description of Artificial Sequence: Synthetic Light chain variable region CDR L1 amino acid sequence
KSSQSLLNARTGKNYLA

SEQ ID NO: 5612 - DNA, 51 bp, Artificial Sequence; identical to SEQ ID NO: 4540
  Description of Artificial Sequence: Synthetic Light chain variable region CDR L1 nucleic acid sequence

SEQ ID NO: 5613 - protein, 7 aa, Artificial Sequence
  Description of Artificial Sequence: Synthetic Light chain variable region CDR L2 amino acid sequence
WASTRES

SEQ ID NO: 5614 - DNA, 21 bp, Artificial Sequence
  Description of Artificial Sequence: Synthetic Light chain variable region CDR L2 nucleic acid sequence
tgggcatctacccgggaatcc

SEQ ID NO: 5615 - protein, 8 aa, Artificial Sequence
  Description of Artificial Sequence: Synthetic Light chain variable region CDR L3 amino acid sequence
KQSYSIRT

SEQ ID NO: 5616 - DNA, 24 bp, Artificial Sequence
  Description of Artificial Sequence: Synthetic Light chain variable region CDR L3 nucleic acid sequence
aagcaatcttattctatcagaact

SEQ ID NO: 5617 - DNA, 357 bp, Artificial Sequence; identical to SEQ ID NO: 5329
  Description of Artificial Sequence: Synthetic Heavy chain variable region nucleic acid sequence

SEQ ID NO: 5618 - protein, 119 aa, Artificial Sequence; identical to SEQ ID NO: 5330
  Description of Artificial Sequence: Synthetic Heavy chain variable region amino acid sequence

SEQ ID NO: 5619 - protein, 9 aa, Artificial Sequence
  Description of Artificial Sequence: Synthetic Heavy chain variable region CDR H1 amino acid sequence
FNIKDYYMH

SEQ ID NO: 5620 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5621 - protein, 17 aa, Artificial Sequence
  Description of Artificial Sequence: Synthetic Heavy chain variable region CDR H2 amino acid sequence
WIDLENANTIYDAKFQG

SEQ ID NO: 5622 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5623 - protein, 12 aa, Artificial Sequence
  Description of Artificial Sequence: Synthetic Heavy chain variable region CDR H3 amino acid sequence
ARDAYGGYFYDV

SEQ ID NO: 5624 - DNA, 36 bp, Artificial Sequence; identical to SEQ ID NO: 5336
  Description of Artificial Sequence: Synthetic Heavy chain variable region CDR H3 nucleic acid sequence

SEQ ID NO: 5625 - DNA, 336 bp, Artificial Sequence; identical to SEQ ID NO: 5529
  Description of Artificial Sequence: Synthetic Light chain variable region nucleic acid sequence

SEQ ID NO: 5626 - protein, 112 aa, Artificial Sequence; identical to SEQ ID NO: 5530
  Description of Artificial Sequence: Synthetic Light chain variable region amino acid sequence

SEQ ID NO: 5627 - protein, 17 aa, Artificial Sequence
  Description of Artificial Sequence: Synthetic Light chain variable region CDR L1 amino acid sequence
KSSQSLLNARTGKNYLA

SEQ ID NO: 5628 - DNA, 51 bp, Artificial Sequence; identical to SEQ ID NO: 4540
  Description of Artificial Sequence: Synthetic Light chain variable region CDR L1 nucleic acid sequence

SEQ ID NO: 5629 - protein, 7 aa, Artificial Sequence
  Description of Artificial Sequence: Synthetic Light chain variable region CDR L2 amino acid sequence
WASTRES

SEQ ID NO: 5630 - DNA, 21 bp, Artificial Sequence
  Description of Artificial Sequence: Synthetic Light chain variable region CDR L2 nucleic acid sequence
tgggcatctacccgggaatcc

SEQ ID NO: 5631 - protein, 8 aa, Artificial Sequence
  Description of Artificial Sequence: Synthetic Light chain variable region CDR L3 amino acid sequence
KQSYSIRT

SEQ ID NO: 5632 - DNA, 24 bp, Artificial Sequence
  Description of Artificial Sequence: Synthetic Light chain variable region CDR L3 nucleic acid sequence
aagcaatcttattctatcagaact

SEQ ID NO: 5633 - DNA, 357 bp, Artificial Sequence; identical to SEQ ID NO: 5345
  Description of Artificial Sequence: Synthetic Heavy chain variable region nucleic acid sequence

SEQ ID NO: 5634 - protein, 119 aa, Artificial Sequence; identical to SEQ ID NO: 5346
  Description of Artificial Sequence: Synthetic Heavy chain variable region amino acid sequence

SEQ ID NO: 5635 - protein, 9 aa, Artificial Sequence
  Description of Artificial Sequence: Synthetic Heavy chain variable region CDR H1 amino acid sequence
FNIKDYYMH

SEQ ID NO: 5636 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5637 - protein, 17 aa, Artificial Sequence
  Description of Artificial Sequence: Synthetic Heavy chain variable region CDR H2 amino acid sequence
WIDLENANTIYDAKFQG

SEQ ID NO: 5638 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5639 - protein, 12 aa, Artificial Sequence
  Description of Artificial Sequence: Synthetic Heavy chain variable region CDR H3 amino acid sequence
ARDNYGGYFYDV

SEQ ID NO: 5640 - DNA, 36 bp, Artificial Sequence; identical to SEQ ID NO: 5352
  Description of Artificial Sequence: Synthetic Heavy chain variable region CDR H3 nucleic acid sequence

SEQ ID NO: 5641 - DNA, 336 bp, Artificial Sequence; identical to SEQ ID NO: 5529
  Description of Artificial Sequence: Synthetic Light chain variable region nucleic acid sequence

SEQ ID NO: 5642 - protein, 112 aa, Artificial Sequence; identical to SEQ ID NO: 5530
  Description of Artificial Sequence: Synthetic Light chain variable region amino acid sequence

SEQ ID NO: 5643 - protein, 17 aa, Artificial Sequence
  Description of Artificial Sequence: Synthetic Light chain variable region CDR L1 amino acid sequence
KSSQSLLNARTGKNYLA

SEQ ID NO: 5644 - DNA, 51 bp, Artificial Sequence; identical to SEQ ID NO: 4540
  Description of Artificial Sequence: Synthetic Light chain variable region CDR L1 nucleic acid sequence

SEQ ID NO: 5645 - protein, 7 aa, Artificial Sequence
  Description of Artificial Sequence: Synthetic Light chain variable region CDR L2 amino acid sequence
WASTRES

SEQ ID NO: 5646 - DNA, 21 bp, Artificial Sequence
  Description of Artificial Sequence: Synthetic Light chain variable region CDR L2 nucleic acid sequence
tgggcatctacccgggaatcc

SEQ ID NO: 5647 - protein, 8 aa, Artificial Sequence
  Description of Artificial Sequence: Synthetic Light chain variable region CDR L3 amino acid sequence
KQSYSIRT

SEQ ID NO: 5648 - DNA, 24 bp, Artificial Sequence
  Description of Artificial Sequence: Synthetic Light chain variable region CDR L3 nucleic acid sequence
aagcaatcttattctatcagaact

SEQ ID NO: 5649 - DNA, 357 bp, Artificial Sequence; identical to SEQ ID NO: 5233
  Description of Artificial Sequence: Synthetic Heavy chain variable region nucleic acid sequence

SEQ ID NO: 5650 - protein, 119 aa, Artificial Sequence; identical to SEQ ID NO: 5234
  Description of Artificial Sequence: Synthetic Heavy chain variable region amino acid sequence

SEQ ID NO: 5651 - protein, 9 aa, Artificial Sequence
  Description of Artificial Sequence: Synthetic Heavy chain variable region CDR H1 amino acid sequence
FNIKDYYMH

SEQ ID NO: 5652 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5653 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5654 - DNA, 51 bp, Artificial Sequence; identical to SEQ ID NO: 5222
  Description of Artificial Sequence: Synthetic Heavy chain variable region CDR H2 nucleic acid sequence

SEQ ID NO: 5655 - protein, 12 aa, Artificial Sequence
  Description of Artificial Sequence: Synthetic Heavy chain variable region CDR H3 amino acid sequence
GRDAYGRYFYDV

SEQ ID NO: 5656 - DNA, 36 bp, Artificial Sequence; identical to SEQ ID NO: 5208
  Description of Artificial Sequence: Synthetic Heavy chain variable region CDR H3 nucleic acid sequence

SEQ ID NO: 5657 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttagaaagcagaaccggaaagaactacttagcttggtaccagcagaaaccaggacagcctcctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctctgagaactttcggcggagggaccaaggtcgagatcaaa

SEQ ID NO: 5658 - protein, 112 aa, Artificial Sequence
  Description of Artificial Sequence: Synthetic Light chain variable region amino acid sequence
DIVMTQSPDSLAVSLGERATINCKSSQSLLESRTGKNYLAWYQQKPGQPPKLLIYWASTRESGVPDRFSGSGSGTDFTLTISSLQAEDVAVYYCKQSYSLRTFGGGTKVEIK

SEQ ID NO: 5659 - protein, 17 aa, Artificial Sequence
  Description of Artificial Sequence: Synthetic Light chain variable region CDR L1 amino acid sequence
KSSQSLLESRTGKNYLA

SEQ ID NO: 5660 - DNA, 51 bp, Artificial Sequence; identical to SEQ ID NO: 4300
  Description of Artificial Sequence: Synthetic Light chain variable region CDR L1 nucleic acid sequence

SEQ ID NO: 5661 - protein, 7 aa, Artificial Sequence
  Description of Artificial Sequence: Synthetic Light chain variable region CDR L2 amino acid sequence
WASTRES

SEQ ID NO: 5662 - DNA, 21 bp, Artificial Sequence
  Description of Artificial Sequence: Synthetic Light chain variable region CDR L2 nucleic acid sequence
tgggcatctacccgggaatcc

SEQ ID NO: 5663 - protein, 8 aa, Artificial Sequence
  Description of Artificial Sequence: Synthetic Light chain variable region CDR L3 amino acid sequence
KQSYSLRT

SEQ ID NO: 5664 - DNA, 24 bp, Artificial Sequence
  Description of Artificial Sequence: Synthetic Light chain variable region CDR L3 nucleic acid sequence
aagcaatcttattctctgagaact

SEQ ID NO: 5665 - DNA, 357 bp, Artificial Sequence; identical to SEQ ID NO: 5297
  Description of Artificial Sequence: Synthetic Heavy chain variable region nucleic acid sequence

SEQ ID NO: 5666 - protein, 119 aa, Artificial Sequence; identical to SEQ ID NO: 5298
  Description of Artificial Sequence: Synthetic Heavy chain variable region amino acid sequence

SEQ ID NO: 5667 - protein, 9 aa, Artificial Sequence
  Description of Artificial Sequence: Synthetic Heavy chain variable region CDR H1 amino acid sequence
FNIKDYYMH

SEQ ID NO: 5668 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5669 - protein, 17 aa, Artificial Sequence
  Description of Artificial Sequence: Synthetic Heavy chain variable region CDR H2 amino acid sequence
WIDLEEGNTIYDAKFQG

SEQ ID NO: 5670 - DNA, 51 bp, Artificial Sequence; identical to SEQ ID NO: 5222
  Description of Artificial Sequence: Synthetic Heavy chain variable region CDR H2 nucleic acid sequence

SEQ ID NO: 5671 - protein, 12 aa, Artificial Sequence
  Description of Artificial Sequence: Synthetic Heavy chain variable region CDR H3 amino acid sequence
ARDVLGRYFYDV

SEQ ID NO: 5672 - DNA, 36 bp, Artificial Sequence; identical to SEQ ID NO: 5272
  Description of Artificial Sequence: Synthetic Heavy chain variable region CDR H3 nucleic acid sequence

SEQ ID NO: 5673 - DNA, 336 bp, Artificial Sequence; identical to SEQ ID NO: 5657
  Description of Artificial Sequence: Synthetic Light chain variable region nucleic acid sequence

SEQ ID NO: 5674 - protein, 112 aa, Artificial Sequence; identical to SEQ ID NO: 5658
  Description of Artificial Sequence: Synthetic Light chain variable region amino acid sequence

SEQ ID NO: 5675 - protein, 17 aa, Artificial Sequence
  Description of Artificial Sequence: Synthetic Light chain variable region CDR L1 amino acid sequence
KSSQSLLESRTGKNYLA

SEQ ID NO: 5676 - DNA, 51 bp, Artificial Sequence; identical to SEQ ID NO: 4300
  Description of Artificial Sequence: Synthetic Light chain variable region CDR L1 nucleic acid sequence

SEQ ID NO: 5677 - protein, 7 aa, Artificial Sequence
  Description of Artificial Sequence: Synthetic Light chain variable region CDR L2 amino acid sequence
WASTRES

SEQ ID NO: 5678 - DNA, 21 bp, Artificial Sequence
  Description of Artificial Sequence: Synthetic Light chain variable region CDR L2 nucleic acid sequence
tgggcatctacccgggaatcc

SEQ ID NO: 5679 - protein, 8 aa, Artificial Sequence
  Description of Artificial Sequence: Synthetic Light chain variable region CDR L3 amino acid sequence
KQSYSLRT

SEQ ID NO: 5680 - DNA, 24 bp, Artificial Sequence
  Description of Artificial Sequence: Synthetic Light chain variable region CDR L3 nucleic acid sequence
aagcaatcttattctctgagaact

SEQ ID NO: 5681 - DNA, 357 bp, Artificial Sequence; identical to SEQ ID NO: 5345
  Description of Artificial Sequence: Synthetic Heavy chain variable region nucleic acid sequence

SEQ ID NO: 5682 - protein, 119 aa, Artificial Sequence; identical to SEQ ID NO: 5346
  Description of Artificial Sequence: Synthetic Heavy chain variable region amino acid sequence

SEQ ID NO: 5683 - protein, 9 aa, Artificial Sequence
  Description of Artificial Sequence: Synthetic Heavy chain variable region CDR H1 amino acid sequence
FNIKDYYMH

SEQ ID NO: 5684 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5685 - protein, 17 aa, Artificial Sequence
  Description of Artificial Sequence: Synthetic Heavy chain variable region CDR H2 amino acid sequence
WIDLENANTIYDAKFQG

SEQ ID NO: 5686 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 5687 - protein, 12 aa, Artificial Sequence
  Description of Artificial Sequence: Synthetic Heavy chain variable region CDR H3 amino acid sequence
ARDNYGGYFYDV

SEQ ID NO: 5688 - DNA, 36 bp, Artificial Sequence; identical to SEQ ID NO: 5352
  Description of Artificial Sequence: Synthetic Heavy chain variable region CDR H3 nucleic acid sequence

SEQ ID NO: 5689 - DNA, 336 bp, Artificial Sequence; identical to SEQ ID NO: 5657
  Description of Artificial Sequence: Synthetic Light chain variable region nucleic acid sequence

SEQ ID NO: 5690 - protein, 112 aa, Artificial Sequence; identical to SEQ ID NO: 5658
  Description of Artificial Sequence: Synthetic Light chain variable region amino acid sequence

SEQ ID NO: 5691 - protein, 17 aa, Artificial Sequence
  Description of Artificial Sequence: Synthetic Light chain variable region CDR L1 amino acid sequence
KSSQSLLESRTGKNYLA

SEQ ID NO: 5692 - DNA, 51 bp, Artificial Sequence; identical to SEQ ID NO: 4300
  Description of Artificial Sequence: Synthetic Light chain variable region CDR L1 nucleic acid sequence

SEQ ID NO: 5693 - protein, 7 aa, Artificial Sequence
  Description of Artificial Sequence: Synthetic Light chain variable region CDR L2 amino acid sequence
WASTRES

SEQ ID NO: 5694 - DNA, 21 bp, Artificial Sequence
  Description of Artificial Sequence: Synthetic Light chain variable region CDR L2 nucleic acid sequence
tgggcatctacccgggaatcc

SEQ ID NO: 5695 - protein, 8 aa, Artificial Sequence
  Description of Artificial Sequence: Synthetic Light chain variable region CDR L3 amino acid sequence
KQSYSLRT

SEQ ID NO: 5696 - DNA, 24 bp, Artificial Sequence
  Description of Artificial Sequence: Synthetic Light chain variable region CDR L3 nucleic acid sequence
aagcaatcttattctctgagaact

SEQ ID NO: 5697 - DNA, 351 bp, Artificial Sequence
  Description of Artificial Sequence: Synthetic Heavy chain variable region nucleic acid sequence
gaagtgaagctgcagcagtctggggctgagcttgtgaggccaggggccttagtcaagttgtcctgcaaagcttctgacttcaacattaaagactactatatgcactgggtgaagcagaggcctgaacagggcctggagtggattggatggattgatcctgagaatggtaatactatatatgacccgaagttccagggcaaggccagtataacagcagacacatcctccaacacagcctacctgcagctcagcagcctgacatctgaggacactgccgtctattactgtggtagggatggtaactacttttttgactactggggccaaggcaccacggtcaccgtctcctca

SEQ ID NO: 5698 - protein, 117 aa, Artificial Sequence
  Description of Artificial Sequence: Synthetic Heavy chain variable region amino acid sequence
EVKLQQSGAELVRPGALVKLSCKASDFNIKDYYMHWVKQRPEQGLEWIGWIDPENGNTIYDPKFQGKASITADTSSNTAYLQLSSLTSEDTAVYYCGRDGNYFFDYWGQGTTVTVSS

SEQ ID NO: 5699 - protein, 9 aa, Artificial Sequence
  Description of Artificial Sequence: Synthetic Heavy chain variable region CDR H1 amino acid sequence
FNIKDYYMH

SEQ ID NO: 5700 - DNA, 27 bp, Artificial Sequence
  Description of Artificial Sequence: Synthetic Heavy chain variable region CDR H1 nucleic acid sequence
ttcaacattaaagactactatatgcac

SEQ ID NO: 5701 - protein, 17 aa, Artificial Sequence
  Description of Artificial Sequence: Synthetic Heavy chain variable region CDR H2 amino acid sequence
WIDPENGNTIYDPKFQG

SEQ ID NO: 5702 - DNA, 51 bp, Artificial Sequence
  Description of Artificial Sequence: Synthetic Heavy chain variable region CDR H2 nucleic acid sequence
tggattgatcctgagaatggtaatactatatatgacccgaagttccagggc

SEQ ID NO: 5703 - protein, 10 aa, Artificial Sequence
  Description of Artificial Sequence: Synthetic Heavy chain variable region CDR H3 amino acid sequence
GRDGNYFFDY

SEQ ID NO: 5704 - DNA, 30 bp, Artificial Sequence
  Description of Artificial Sequence: Synthetic Heavy chain variable region CDR H3 nucleic acid sequence
ggtagggatggtaactacttttttgactac

SEQ ID NO: 5705 - DNA, 336 bp, Artificial Sequence
  Description of Artificial Sequence: Synthetic Light chain variable region nucleic acid sequence
gacatccagctgactcagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggagtccctgatcgcttcacaggcagtggatctgggacagatttcactctcaccatcagcagtgtgcaggctgaagacctggcagtttattactgcaagcaatcttataatcttcggacgttcggtggagggaccaagctggagctgaaa

SEQ ID NO: 5706 - protein, 112 aa, Artificial Sequence; identical to SEQ ID NO: 2810
  Description of Artificial Sequence: Synthetic Light chain variable region amino acid sequence

SEQ ID NO: 5707 - protein, 17 aa, Artificial Sequence
  Description of Artificial Sequence: Synthetic Light chain variable region CDR L1 amino acid sequence
KSSQSLLNSRTRKNYLA

SEQ ID NO: 5708 - DNA, 51 bp, Artificial Sequence; identical to SEQ ID NO: 2764
  Description of Artificial Sequence: Synthetic Light chain variable region CDR L1 nucleic acid sequence

SEQ ID NO: 5709 - protein, 7 aa, Artificial Sequence
  Description of Artificial Sequence: Synthetic Light chain variable region CDR L2 amino acid sequence
WASTRES

SEQ ID NO: 5710 - DNA, 21 bp, Artificial Sequence
  Description of Artificial Sequence: Synthetic Light chain variable region CDR L2 nucleic acid sequence
tgggcatccactagggaatct

SEQ ID NO: 5711 - protein, 8 aa, Artificial Sequence
  Description of Artificial Sequence: Synthetic Light chain variable region CDR L3 amino acid sequence
KQSYNLRT

SEQ ID NO: 5712 - DNA, 24 bp, Artificial Sequence
  Description of Artificial Sequence: Synthetic Light chain variable region CDR L3 nucleic acid sequence
aagcaatcttataatcttcggacg

SEQ ID NO: 5713 - DNA, 351 bp, Artificial Sequence
  Description of Artificial Sequence: Synthetic Heavy chain variable region nucleic acid sequence
gaagtgcagctgcagcagtcaggacctgagctggtgaagcctggggcttcagtgaggatctcctgcaaggcttctgactacaccttcacaagctactatattcactgggtgaagcagaggcctggacagggacttgagtggattggatggatttatcctggaaatgttaatactaagtacaatgagaatttcaaggacaaggccacactgactgcagacaaatcctccagcacagcctacatgcacctcagcagcctgacctctgaggactctgcggtctatttctgtgcaagagatgatggttactactttgactactggggccaaggcaccacggtcaccgtctcctca

SEQ ID NO: 5714 - protein, 117 aa, Artificial Sequence
  Description of Artificial Sequence: Synthetic Heavy chain variable region amino acid sequence
EVQLQQSGPELVKPGASVRISCKASDYTFTSYYIHWVKQRPGQGLEWIGWIYPGNVNTKYNENFKDKATLTADKSSSTAYMHLSSLTSEDSAVYFCARDDGYYFDYWGQGTTVTVSS

SEQ ID NO: 5715 - protein, 9 aa, Artificial Sequence
  Description of Artificial Sequence: Synthetic Heavy chain variable region CDR H1 amino acid sequence
YTFTSYYIH

SEQ ID NO: 5716 - DNA, 27 bp, Artificial Sequence
  Description of Artificial Sequence: Synthetic Heavy chain variable region CDR H1 nucleic acid sequence
tacaccttcacaagctactatattcac

SEQ ID NO: 5717 - protein, 17 aa, Artificial Sequence
  Description of Artificial Sequence: Synthetic Heavy chain variable region CDR H2 amino acid sequence
WIYPGNVNTKYNENFKD

SEQ ID NO: 5718 - DNA, 51 bp, Artificial Sequence
  Description of Artificial Sequence: Synthetic Heavy chain variable region CDR H2 nucleic acid sequence
tggatttatcctggaaatgttaatactaagtacaatgagaatttcaaggac

SEQ ID NO: 5719 - protein, 10 aa, Artificial Sequence
  Description of Artificial Sequence: Synthetic Heavy chain variable region CDR H3 amino acid sequence
ARDDGYYFDY

SEQ ID NO: 5720 - DNA, 30 bp, Artificial Sequence
  Description of Artificial Sequence: Synthetic Heavy chain variable region CDR H3 nucleic acid sequence
gcaagagatgatggttactactttgactac

SEQ ID NO: 5721 - DNA, 336 bp, Artificial Sequence
  Description of Artificial Sequence: Synthetic Light chain variable region nucleic acid sequence
gacatccagctgacccagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggaggcacaaagctggaaatcaaa

SEQ ID NO: 5722 - protein, 112 aa, Artificial Sequence; identical to SEQ ID NO: 2794
  Description of Artificial Sequence: Synthetic Light chain variable region amino acid sequence

SEQ ID NO: 5723 - protein, 17 aa, Artificial Sequence
  Description of Artificial Sequence: Synthetic Light chain variable region CDR L1 amino acid sequence
KSSQSLLNSRTRKNYLA

SEQ ID NO: 5724 - DNA, 51 bp, Artificial Sequence; identical to SEQ ID NO: 2764
  Description of Artificial Sequence: Synthetic Light chain variable region CDR L1 nucleic acid sequence

SEQ ID NO: 5725 - protein, 7 aa, Artificial Sequence
  Description of Artificial Sequence: Synthetic Light chain variable region CDR L2 amino acid sequence
WASTRES

SEQ ID NO: 5726 - DNA, 21 bp, Artificial Sequence
  Description of Artificial Sequence: Synthetic Light chain variable region CDR L2 nucleic acid sequence
tgggcatccactagggaatct

SEQ ID NO: 5727 - protein, 8 aa, Artificial Sequence
  Description of Artificial Sequence: Synthetic Light chain variable region CDR L3 amino acid sequence
KQSYNLRT

SEQ ID NO: 5728 - DNA, 24 bp, Artificial Sequence
  Description of Artificial Sequence: Synthetic Light chain variable region CDR L3 nucleic acid sequence
aagcaatcttataatcttcggacg

SEQ ID NO: 5729 - DNA, 357 bp, Artificial Sequence
  Description of Artificial Sequence: Synthetic Heavy chain variable region nucleic acid sequence
caagtcaagctggagcagtctggacctgagctggtgaagcctggggcttcagtgaagatgtcctgcaaggcttctggctacaccttcacaaactactatatacactgggtgaagcagaggcctggacagggacttgagtggattggatggatttatcctgaagatggtaatactaaatacaatgagaaattcaagggcaagaccacactgactgcagacaaatcctccagcacagcctacatgttgctcagcagcctgacctctgaggactctgcgatctatttctgtgcaaggaataacggtagtagctatgctatggactactggggccaaggcaccacggtcaccgtctcctca

SEQ ID NO: 5730 - protein, 119 aa, Artificial Sequence
  Description of Artificial Sequence: Synthetic Heavy chain variable region amino acid sequence
QVKLEQSGPELVKPGASVKMSCKASGYTFTNYYIHWVKQRPGQGLEWIGWIYPEDGNTKYNEKFKGKTTLTADKSSSTAYMLLSSLTSEDSAIYFCARNNGSSYAMDYWGQGTTVTVSS

SEQ ID NO: 5731 - protein, 9 aa, Artificial Sequence
  Description of Artificial Sequence: Synthetic Heavy chain variable region CDR H1 amino acid sequence
YTFTNYYIH

SEQ ID NO: 5732 - DNA, 27 bp, Artificial Sequence
  Description of Artificial Sequence: Synthetic Heavy chain variable region CDR H1 nucleic acid sequence
tacaccttcacaaactactatatacac

SEQ ID NO: 5733 - protein, 17 aa, Artificial Sequence
  Description of Artificial Sequence: Synthetic Heavy chain variable region CDR H2 amino acid sequence
WIYPEDGNTKYNEKFKG

SEQ ID NO: 5734 - DNA, 51 bp, Artificial Sequence
  Description of Artificial Sequence: Synthetic Heavy chain variable region CDR H2 nucleic acid sequence
tggatttatcctgaagatggtaatactaaatacaatgagaaattcaagggc

SEQ ID NO: 5735 - protein, 12 aa, Artificial Sequence
  Description of Artificial Sequence: Synthetic Heavy chain variable region CDR H3 amino acid sequence
ARNNGSSYAMDY

SEQ ID NO: 5736 - DNA, 36 bp, Artificial Sequence
  Description of Artificial Sequence: Synthetic Heavy chain variable region CDR H3 nucleic acid sequence
gcaaggaataacggtagtagctatgctatggactac

SEQ ID NO: 5737 - DNA, 336 bp, Artificial Sequence
  Description of Artificial Sequence: Synthetic Light chain variable region nucleic acid sequence
ggcatccagctgactcagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcagtcttataatcttcggacgttcggtggagggaccaagctggagctgaaa

SEQ ID NO: 5738 - protein, 112 aa, Artificial Sequence
  Description of Artificial Sequence: Synthetic Light chain variable region amino acid sequence
GIQLTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLRTFGGGTKLELK

SEQ ID NO: 5739 - protein, 17 aa, Artificial Sequence
  Description of Artificial Sequence: Synthetic Light chain variable region CDR L1 amino acid sequence
KSSQSLLNSRTRKNYLA

SEQ ID NO: 5740 - DNA, 51 bp, Artificial Sequence; identical to SEQ ID NO: 2764
  Description of Artificial Sequence: Synthetic Light chain variable region CDR L1 nucleic acid sequence

SEQ ID NO: 5741 - protein, 7 aa, Artificial Sequence
  Description of Artificial Sequence: Synthetic Light chain variable region CDR L2 amino acid sequence
WASTRES

SEQ ID NO: 5742 - DNA, 21 bp, Artificial Sequence
  Description of Artificial Sequence: Synthetic Light chain variable region CDR L2 nucleic acid sequence
tgggcatccactagggaatct

SEQ ID NO: 5743 - protein, 8 aa, Artificial Sequence
  Description of Artificial Sequence: Synthetic Light chain variable region CDR L3 amino acid sequence
KQSYNLRT

SEQ ID NO: 5744 - DNA, 24 bp, Artificial Sequence
  Description of Artificial Sequence: Synthetic Light chain variable region CDR L3 nucleic acid sequence
aagcagtcttataatcttcggacg

SEQ ID NO: 5745 - DNA, 351 bp, Artificial Sequence
  Description of Artificial Sequence: Synthetic Heavy chain variable region nucleic acid sequence
caagtacagctggagcagtcaggacctgagctggtgaagcctggggcttcagtgaggatatcctgcaaggcttctggctacaccttcacaagctactatatacactgggtgaggcagaggcctggtcagggacttgagtggattggatggatttttcctggaaatgttaatactaagtacaatgagaagttcaagggcaaggccacactgactgcagacaaatcctccagcacagcctacatgcagctcagcagcctgacctctgaggactctgcggtctatttctgtgcaagagatggtaactactcctttgcttactggggccaaggcaccacggtcaccgtctcctca

SEQ ID NO: 5746 - protein, 117 aa, Artificial Sequence
  Description of Artificial Sequence: Synthetic Heavy chain variable region amino acid sequence
QVQLEQSGPELVKPGASVRISCKASGYTFTSYYIHWVRQRPGQGLEWIGWIFPGNVNTKYNEKFKGKATLTADKSSSTAYMQLSSLTSEDSAVYFCARDGNYSFAYWGQGTTVTVSS

SEQ ID NO: 5747 - protein, 9 aa, Artificial Sequence
  Description of Artificial Sequence: Synthetic Heavy chain variable region CDR H1 amino acid sequence
YTFTSYYIH

SEQ ID NO: 5748 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 5749 - protein, 17 aa, Artificial Sequence
  Description of Artificial Sequence: Synthetic Heavy chain variable region CDR H2 amino acid sequence
WIFPGNVNTKYNEKFKG

SEQ ID NO: 5750 - DNA, 51 bp, Artificial Sequence
  Description of Artificial Sequence: Synthetic Heavy chain variable region CDR H2 nucleic acid sequence
tggatttttcctggaaatgttaatactaagtacaatgagaagttcaagggc

SEQ ID NO: 5751 - protein, 10 aa, Artificial Sequence
  Description of Artificial Sequence: Synthetic Heavy chain variable region CDR H3 amino acid sequence
ARDGNYSFAY

SEQ ID NO: 5752 - DNA, 30 bp, Artificial Sequence
  Description of Artificial Sequence: Synthetic Heavy chain variable region CDR H3 nucleic acid sequence
gcaagagatggtaactactcctttgcttac

SEQ ID NO: 5753 - DNA, 336 bp, Artificial Sequence
  Description of Artificial Sequence: Synthetic Light chain variable region nucleic acid sequence
gacattcagctcactcagtctccatcctccctggctgtgtcagcaggagagaaggtcactatgagctgcaaatccagtcagagtctgctcaacagtagaacccgaaagaactacttggcttggtaccagcaaaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggagggacaaagctggaaataaaa

SEQ ID NO: 5754 - protein, 112 aa, Artificial Sequence; identical to SEQ ID NO: 2794
  Description of Artificial Sequence: Synthetic Light chain variable region amino acid sequence

SEQ ID NO: 5755 - protein, 17 aa, Artificial Sequence
  Description of Artificial Sequence: Synthetic Light chain variable region CDR L1 amino acid sequence
KSSQSLLNSRTRKNYLA

SEQ ID NO: 5756 - DNA, 51 bp, Artificial Sequence; identical to SEQ ID NO: 2764
  Description of Artificial Sequence: Synthetic Light chain variable region CDR L1 nucleic acid sequence

SEQ ID NO: 5757 - protein, 7 aa, Artificial Sequence
  Description of Artificial Sequence: Synthetic Light chain variable region CDR L2 amino acid sequence
WASTRES

SEQ ID NO: 5758 - DNA, 21 bp, Artificial Sequence
  Description of Artificial Sequence: Synthetic Light chain variable region CDR L2 nucleic acid sequence
tgggcatccactagggaatct

SEQ ID NO: 5759 - protein, 8 aa, Artificial Sequence
  Description of Artificial Sequence: Synthetic Light chain variable region CDR L3 amino acid sequence
KQSYNLRT

SEQ ID NO: 5760 - DNA, 24 bp, Artificial Sequence
  Description of Artificial Sequence: Synthetic Light chain variable region CDR L3 nucleic acid sequence
aagcaatcttataatcttcggacg

SEQ ID NO: 5761 - DNA, 351 bp, Artificial Sequence
  Description of Artificial Sequence: Synthetic Heavy chain variable region nucleic acid sequence
caggtgaagctggagcagtctggacctgagctggtgaagcctggggcttcagtgaggatatcctgcaaggcttctggctacaccttcacaacctactatatacactgggtgaagcagaggcctggacagggacttgagtggattggatggatttatcctggaaatgttaatgctaagtacaatgagaagttcaagggcaaggccacactgactgcagacaaatcctccagcacagcctacatgcagctcagcagcctgacctctgaggactctgcggtctatttctgtgcaagagatgatgggtactactttgactactggggccaaggcaccacggtcaccgtctcctca

SEQ ID NO: 5762 - protein, 117 aa, Artificial Sequence
  Description of Artificial Sequence: Synthetic Heavy chain variable region amino acid sequence
QVKLEQSGPELVKPGASVRISCKASGYTFTTYYIHWVKQRPGQGLEWIGWIYPGNVNAKYNEKFKGKATLTADKSSSTAYMQLSSLTSEDSAVYFCARDDGYYFDYWGQGTTVTVSS

SEQ ID NO: 5763 - protein, 9 aa, Artificial Sequence
  Description of Artificial Sequence: Synthetic Heavy chain variable region CDR H1 amino acid sequence
YTFTTYYIH

SEQ ID NO: 5764 - DNA, 27 bp, Artificial Sequence
  Description of Artificial Sequence: Synthetic Heavy chain variable region CDR H1 nucleic acid sequence
tacaccttcacaacctactatatacac

SEQ ID NO: 5765 - protein, 17 aa, Artificial Sequence
  Description of Artificial Sequence: Synthetic Heavy chain variable region CDR H2 amino acid sequence
WIYPGNVNAKYNEKFKG

SEQ ID NO: 5766 - DNA, 51 bp, Artificial Sequence
  Description of Artificial Sequence: Synthetic Heavy chain variable region CDR H2 nucleic acid sequence
tggatttatcctggaaatgttaatgctaagtacaatgagaagttcaagggc

SEQ ID NO: 5767 - protein, 10 aa, Artificial Sequence
  Description of Artificial Sequence: Synthetic Heavy chain variable region CDR H3 amino acid sequence
ARDDGYYFDY

SEQ ID NO: 5768 - DNA, 30 bp, Artificial Sequence
  Description of Artificial Sequence: Synthetic Heavy chain variable region CDR H3 nucleic acid sequence
gcaagagatgatgggtactactttgactac

SEQ ID NO: 5769 - DNA, 336 bp, Artificial Sequence
  Description of Artificial Sequence: Synthetic Light chain variable region nucleic acid sequence
gacatccagctgactcagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggaggcacaaagctggaaaataaa

SEQ ID NO: 5770 - protein, 112 aa, Artificial Sequence
  Description of Artificial Sequence: Synthetic Light chain variable region amino acid sequence
DIQLTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLRTFGGGTKLENK

SEQ ID NO: 5771 - protein, 17 aa, Artificial Sequence
  Description of Artificial Sequence: Synthetic Light chain variable region CDR L1 amino acid sequence
KSSQSLLNSRTRKNYLA

SEQ ID NO: 5772 - DNA, 51 bp, Artificial Sequence; identical to SEQ ID NO: 2764
  Description of Artificial Sequence: Synthetic Light chain variable region CDR L1 nucleic acid sequence

SEQ ID NO: 5773 - protein, 7 aa, Artificial Sequence
  Description of Artificial Sequence: Synthetic Light chain variable region CDR L2 amino acid sequence
WASTRES

SEQ ID NO: 5774 - DNA, 21 bp, Artificial Sequence
  Description of Artificial Sequence: Synthetic Light chain variable region CDR L2 nucleic acid sequence
tgggcatccactagggaatct

SEQ ID NO: 5775 - protein, 8 aa, Artificial Sequence
  Description of Artificial Sequence: Synthetic Light chain variable region CDR L3 amino acid sequence
KQSYNLRT

SEQ ID NO: 5776 - DNA, 24 bp, Artificial Sequence
  Description of Artificial Sequence: Synthetic Light chain variable region CDR L3 nucleic acid sequence
aagcaatcttataatcttcggacg

SEQ ID NO: 5777 - DNA, 351 bp, Artificial Sequence
  Description of Artificial Sequence: Synthetic Heavy chain variable region nucleic acid sequence
gaggtccagctgcaacaatcaggacctgagctggtgaagcctggggcctcagtgagggtatcctgcaaggcttctggctacaccttcacaagctactatatacactgggtgaagcagaggcctggacagggacttgagtggattggatggatttatcctggaaatgttaatactcagtacaatgagaagttcaagggcaaggccacactgactgcagacaaatcctccagcacaacctacatgcagctcagcagcctgacctctgaggactctgcggtctatttctgtgcaagagatggtgattactactttgactactggggccaaggcaccacggtcaccgtctcctca

SEQ ID NO: 5778 - protein, 117 aa, Artificial Sequence
  Description of Artificial Sequence: Synthetic Heavy chain variable region amino acid sequence
EVQLQQSGPELVKPGASVRVSCKASGYTFTSYYIHWVKQRPGQGLEWIGWIYPGNVNTQYNEKFKGKATLTADKSSSTTYMQLSSLTSEDSAVYFCARDGDYYFDYWGQGTTVTVSS

SEQ ID NO: 5779 - protein, 9 aa, Artificial Sequence
  Description of Artificial Sequence: Synthetic Heavy chain variable region CDR H1 amino acid sequence
YTFTSYYIH

SEQ ID NO: 5780 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 5781 - protein, 17 aa, Artificial Sequence
  Description of Artificial Sequence: Synthetic Heavy chain variable region CDR H2 amino acid sequence
WIYPGNVNTQYNEKFKG

SEQ ID NO: 5782 - DNA, 51 bp, Artificial Sequence
  Description of Artificial Sequence: Synthetic Heavy chain variable region CDR H2 nucleic acid sequence
tggatttatcctggaaatgttaatactcagtacaatgagaagttcaagggc

SEQ ID NO: 5783 - protein, 10 aa, Artificial Sequence
  Description of Artificial Sequence: Synthetic Heavy chain variable region CDR H3 amino acid sequence
ARDGDYYFDY

SEQ ID NO: 5784 - DNA, 30 bp, Artificial Sequence; identical to SEQ ID NO: 2792
  Description of Artificial Sequence: Synthetic Heavy chain variable region CDR H3 nucleic acid sequence

SEQ ID NO: 5785 - DNA, 336 bp, Artificial Sequence
  Description of Artificial Sequence: Synthetic Light chain variable region nucleic acid sequence
ggcattcagctgacccagtctccatcctccctggctgtgtcagcaggagagaaggtcactatgacctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggaggcacaaagttggaaataaaa

SEQ ID NO: 5786 - protein, 112 aa, Artificial Sequence
  Description of Artificial Sequence: Synthetic Light chain variable region amino acid sequence
GIQLTQSPSSLAVSAGEKVTMTCKSSQSLLNSRTRKNYLAWYQQKPGQSPKLLIYWASTRESGVPDRFTGSGSGTDFTLTISSVQAEDLAVYYCKQSYNLRTFGGGTKLEIK

SEQ ID NO: 5787 - protein, 17 aa, Artificial Sequence
  Description of Artificial Sequence: Synthetic Light chain variable region CDR L1 amino acid sequence
KSSQSLLNSRTRKNYLA

SEQ ID NO: 5788 - DNA, 51 bp, Artificial Sequence; identical to SEQ ID NO: 2764
  Description of Artificial Sequence: Synthetic Light chain variable region CDR L1 nucleic acid sequence

SEQ ID NO: 5789 - protein, 7 aa, Artificial Sequence
  Description of Artificial Sequence: Synthetic Light chain variable region CDR L2 amino acid sequence
WASTRES

SEQ ID NO: 5790 - DNA, 21 bp, Artificial Sequence
  Description of Artificial Sequence: Synthetic Light chain variable region CDR L2 nucleic acid sequence
tgggcatccactagggaatct

SEQ ID NO: 5791 - protein, 8 aa, Artificial Sequence
  Description of Artificial Sequence: Synthetic Light chain variable region CDR L3 amino acid sequence
KQSYNLRT

SEQ ID NO: 5792 - DNA, 24 bp, Artificial Sequence
  Description of Artificial Sequence: Synthetic Light chain variable region CDR L3 nucleic acid sequence
aagcaatcttataatcttcggacg

SEQ ID NO: 5793 - DNA, 351 bp, Artificial Sequence
  Description of Artificial Sequence: Synthetic Heavy chain variable region nucleic acid sequence
gaggtcaagctgcaggagtctggacctgagctggtgaagcctggggcttcagtgaggatatcctgcaaggcttctggctacaccttcacaagctactatatacactgggtgaagcagaggcctggacagggacttgagtggattggatggatttatcctggaaatgttaatactaagtacaatgagaagttcaagggcaaggccacactgactgcagacaaatcctccagcacagcctacatgcagctcagcagcctgacctctgaggactctgcggtctatttctgtgcaagagatggtgattacttctttgactactggggccaaggcaccacggtcaccgtctcctca

SEQ ID NO: 5794 - protein, 117 aa, Artificial Sequence
  Description of Artificial Sequence: Synthetic Heavy chain variable region amino acid sequence
EVKLQESGPELVKPGASVRISCKASGYTFTSYYIHWVKQRPGQGLEWIGWIYPGNVNTKYNEKFKGKATLTADKSSSTAYMQLSSLTSEDSAVYFCARDGDYFFDYWGQGTTVTVSS

SEQ ID NO: 5795 - protein, 9 aa, Artificial Sequence
  Description of Artificial Sequence: Synthetic Heavy chain variable region CDR H1 amino acid sequence
YTFTSYYIH

SEQ ID NO: 5796 - DNA, 27 bp, Artificial Sequence
  Description of Artificial Sequence: Synthetic Heavy chain variable region CDR H1 nucleic acid sequence
tacaccttcacaagctactatatacac

SEQ ID NO: 5797 - protein, 17 aa, Artificial Sequence
  Description of Artificial Sequence: Synthetic Heavy chain variable region CDR H2 amino acid sequence
WIYPGNVNTKYNEKFKG

SEQ ID NO: 5798 - DNA, 51 bp, Artificial Sequence; identical to SEQ ID NO: 2806
  Description of Artificial Sequence: Synthetic Heavy chain variable region CDR H2 nucleic acid sequence

SEQ ID NO: 5799 - protein, 10 aa, Artificial Sequence
  Description of Artificial Sequence: Synthetic Heavy chain variable region CDR H3 amino acid sequence
ARDGDYFFDY

SEQ ID NO: 5800 - DNA, 30 bp, Artificial Sequence
  Description of Artificial Sequence: Synthetic Heavy chain variable region CDR H3 nucleic acid sequence
gcaagagatggtgattacttctttgactac

SEQ ID NO: 5801 - DNA, 336 bp, Artificial Sequence
  Description of Artificial Sequence: Synthetic Light chain variable region nucleic acid sequence
gacatccagctcacccagtctccatcctccctggctgtgtcagcaggagagaaggtcactatgagctgcaaatccagtcagagtctgctcaacagtagaacccaaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttcggacgttcggtggaggcaccaagctgaaaatcaaa

SEQ ID NO: 5802 - protein, 112 aa, Artificial Sequence
  Description of Artificial Sequence: Synthetic Light chain variable region amino acid sequence
DIQLTQSPSSLAVSAGEKVTMSCKSSQSLLNSRTQKNYLAWYQQKPGQSPKLLIYWASTRESGVPDRFTGSGSGTDFTLTISSVQAEDLAVYYCKQSYNLRTFGGGTKLKIK

SEQ ID NO: 5803 - protein, 17 aa, Artificial Sequence
  Description of Artificial Sequence: Synthetic Light chain variable region CDR L1 amino acid sequence
KSSQSLLNSRTQKNYLA

SEQ ID NO: 5804 - DNA, 51 bp, Artificial Sequence
  Description of Artificial Sequence: Synthetic Light chain variable region CDR L1 nucleic acid sequence
aaatccagtcagagtctgctcaacagtagaacccaaaagaactacttggct

SEQ ID NO: 5805 - protein, 7 aa, Artificial Sequence
  Description of Artificial Sequence: Synthetic Light chain variable region CDR L2 amino acid sequence
WASTRES

SEQ ID NO: 5806 - DNA, 21 bp, Artificial Sequence
  Description of Artificial Sequence: Synthetic Light chain variable region CDR L2 nucleic acid sequence
tgggcatccactagggaatct

SEQ ID NO: 5807 - protein, 8 aa, Artificial Sequence
  Description of Artificial Sequence: Synthetic Light chain variable region CDR L3 amino acid sequence
KQSYNLRT

SEQ ID NO: 5808 - DNA, 24 bp, Artificial Sequence
  Description of Artificial Sequence: Synthetic Light chain variable region CDR L3 nucleic acid sequence
aagcaatcttataatcttcggacg

SEQ ID NO: 5809 - DNA, 375 bp, Artificial Sequence
  Description of Artificial Sequence: Synthetic Heavy chain variable region nucleic acid sequence
gaggtgcagctggtggagtctgggggaggcttggtccagcctggagggtccctgaaactctcctgtgcagcctctggattcaccttcaataaatacgccatgaactgggtccgccaggctccagggaaggggctggagtgggttgcccgtattagaagcaaatataacaattacgccacatactacgccgactctgtgaaagacagattcaccatctcaagagatgattcaaagaacacagcgtatctgcaaatgaacaacctgaaaaccgaggacacggcggtgtactactgcgtgaggcacggcaacttcgggaattcctatatttcatactgggcctactggggccaaggaaccctggtcaccgtctcctca

SEQ ID NO: 5810 - protein, 125 aa, Artificial Sequence
  Description of Artificial Sequence: Synthetic Heavy chain variable region amino acid sequence
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 5811 - protein, 9 aa, Artificial Sequence
  Description of Artificial Sequence: Synthetic Heavy chain variable region CDR H1 amino acid sequence
FTFNKYAMN

SEQ ID NO: 5812 - DNA, 27 bp, Artificial Sequence
  Description of Artificial Sequence: Synthetic Heavy chain variable region CDR H1 nucleic acid sequence
ttcaccttcaataaatacgccatgaac

SEQ ID NO: 5813 - protein, 19 aa, Artificial Sequence
  Description of Artificial Sequence: Synthetic Heavy chain variable region CDR H2 amino acid sequence
RIRSKYNNYATYYADSVKD

SEQ ID NO: 5814 - DNA, 57 bp, Artificial Sequence
  Description of Artificial Sequence: Synthetic Heavy chain variable region CDR H2 nucleic acid sequence
cgtattagaagcaaatataacaattacgccacatactacgccgactctgtgaaagac

SEQ ID NO: 5815 - protein, 16 aa, Artificial Sequence
  Description of Artificial Sequence: Synthetic Heavy chain variable region CDR H3 amino acid sequence
VRHGNFGNSYISYWAY

SEQ ID NO: 5816 - DNA, 48 bp, Artificial Sequence
  Description of Artificial Sequence: Synthetic Heavy chain variable region CDR H3 nucleic acid sequence
gtgaggcacggcaacttcgggaattcctatatttcatactgggcctac

SEQ ID NO: 5817 - DNA, 327 bp, Artificial Sequence
  Description of Artificial Sequence: Synthetic Light chain variable region nucleic acid sequence
cagactgtggtgactcaggagccctcactgactgtgtccccaggagggacagtcactctcacctgtggctccagcactggagctgtcaccagtggtaattatcccaactgggtccagcagaagcctggccaagcccccaggggactgattggtggtacaaaattcctggcccccgggacacctgcccggttctcaggctccctccttgggggcaaagctgccctgaccctttcgggtgtgcagcctgaggatgaggctgagtattactgcgtgctctggtatagtaatcggtgggtgttcggcggagggaccaagctgaccgtccta

SEQ ID NO: 5818 - protein, 109 aa, Artificial Sequence
  Description of Artificial Sequence: Synthetic Light chain variable region amino acid sequence
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 5819 - protein, 14 aa, Artificial Sequence
  Description of Artificial Sequence: Synthetic Light chain variable region CDR L1 amino acid sequence
GSSTGAVTSGNYPN

SEQ ID NO: 5820 - DNA, 42 bp, Artificial Sequence
  Description of Artificial Sequence: Synthetic Light chain variable region CDR L1 nucleic acid sequence
ggctccagcactggagctgtcaccagtggtaattatcccaac

SEQ ID NO: 5821 - protein, 7 aa, Artificial Sequence
  Description of Artificial Sequence: Synthetic Light chain variable region CDR L2 amino acid sequence
GTKFLAP

SEQ ID NO: 5822 - DNA, 21 bp, Artificial Sequence
  Description of Artificial Sequence: Synthetic Light chain variable region CDR L2 nucleic acid sequence
ggtacaaaattcctggccccc

SEQ ID NO: 5823 - protein, 9 aa, Artificial Sequence
  Description of Artificial Sequence: Synthetic Light chain variable region CDR L3 amino acid sequence
VLWYSNRWV

SEQ ID NO: 5824 - DNA, 27 bp, Artificial Sequence
  Description of Artificial Sequence: Synthetic Light chain variable region CDR L3 nucleic acid sequence
gtgctctggtatagtaatcggtgggtg

SEQ ID NO: 5825 - DNA, 375 bp, Artificial Sequence; identical to SEQ ID NO: 5809
  Description of Artificial Sequence: Synthetic Heavy chain variable region nucleic acid sequence

SEQ ID NO: 5826 - protein, 125 aa, Artificial Sequence; identical to SEQ ID NO: 5810
  Description of Artificial Sequence: Synthetic Heavy chain variable region amino acid sequence

SEQ ID NO: 5827 - protein, 9 aa, Artificial Sequence
  Description of Artificial Sequence: Synthetic Heavy chain variable region CDR H1 amino acid sequence
FTFNKYAMN

SEQ ID NO: 5828 - DNA, 27 bp, Artificial Sequence
  Description of Artificial Sequence: Synthetic Heavy chain variable region CDR H1 nucleic acid sequence
ttcaccttcaataaatacgccatgaac

SEQ ID NO: 5829 - protein, 19 aa, Artificial Sequence
  Description of Artificial Sequence: Synthetic Heavy chain variable region CDR H2 amino acid sequence
RIRSKYNNYATYYADSVKD

SEQ ID NO: 5830 - DNA, 57 bp, Artificial Sequence; identical to SEQ ID NO: 5814
  Description of Artificial Sequence: Synthetic Heavy chain variable region CDR H2 nucleic acid sequence

SEQ ID NO: 5831 - protein, 16 aa, Artificial Sequence
  Description of Artificial Sequence: Synthetic Heavy chain variable region CDR H3 amino acid sequence
VRHGNFGNSYISYWAY

SEQ ID NO: 5832 - DNA, 48 bp, Artificial Sequence; identical to SEQ ID NO: 5816
  Description of Artificial Sequence: Synthetic Heavy chain variable region CDR H3 nucleic acid sequence

SEQ ID NO: 5833 - DNA, 327 bp, Artificial Sequence; identical to SEQ ID NO: 5817
  Description of Artificial Sequence: Synthetic Light chain variable region nucleic acid sequence

SEQ ID NO: 5834 - protein, 109 aa, Artificial Sequence; identical to SEQ ID NO: 5818
  Description of Artificial Sequence: Synthetic Light chain variable region amino acid sequence

SEQ ID NO: 5835 - protein, 14 aa, Artificial Sequence
  Description of Artificial Sequence: Synthetic Light chain variable region CDR L1 amino acid sequence
GSSTGAVTSGNYPN

SEQ ID NO: 5836 - DNA, 42 bp, Artificial Sequence; identical to SEQ ID NO: 5820
  Description of Artificial Sequence: Synthetic Light chain variable region CDR L1 nucleic acid sequence

SEQ ID NO: 5837 - protein, 7 aa, Artificial Sequence
  Description of Artificial Sequence: Synthetic Light chain variable region CDR L2 amino acid sequence
GTKFLAP

SEQ ID NO: 5838 - DNA, 21 bp, Artificial Sequence
  Description of Artificial Sequence: Synthetic Light chain variable region CDR L2 nucleic acid sequence
ggtacaaaattcctggccccc

SEQ ID NO: 5839 - protein, 9 aa, Artificial Sequence
  Description of Artificial Sequence: Synthetic Light chain variable region CDR L3 amino acid sequence
VLWYSNRWV

SEQ ID NO: 5840 - DNA, 27 bp, Artificial Sequence
  Description of Artificial Sequence: Synthetic Light chain variable region CDR L3 nucleic acid sequence
gtgctctggtatagtaatcggtgggtg

SEQ ID NO: 5841 - DNA, 357 bp, Artificial Sequence
  Description of Artificial Sequence: Synthetic Heavy chain variable region nucleic acid sequence
gaggtgcagctggtgcagtctggggctgaggtgaagaagcctggggcctcagtgaaggtttcctgcaaggcatctggattcaccttcaccagctactatatacactgggtgcgacaggcccctggacaagggcttgagtggataggatggatctaccctgaaaatgataacacaaagtacaacgagaagttcaaggacagagtcaccataaccgcggacacgtccacgagcacagcctacctggagctgagcagcctgagatctgaggacacggcggtgtactactgcgccagggacggatattctagatattactttgactactggggccaaggaaccctggtcaccgtctcctca

SEQ ID NO: 5842 - protein, 119 aa, Artificial Sequence
  Description of Artificial Sequence: Synthetic Heavy chain variable region amino acid sequence
EVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDGYSRYYFDYWGQGTLVTVSS

SEQ ID NO: 5843 - protein, 9 aa, Artificial Sequence
  Description of Artificial Sequence: Synthetic Heavy chain variable region CDR H1 amino acid sequence
FTFTSYYIH

SEQ ID NO: 5844 - DNA, 27 bp, Artificial Sequence
  Description of Artificial Sequence: Synthetic Heavy chain variable region CDR H1 nucleic acid sequence
ttcaccttcaccagctactatatacac

SEQ ID NO: 5845 - protein, 17 aa, Artificial Sequence
  Description of Artificial Sequence: Synthetic Heavy chain variable region CDR H2 amino acid sequence
WIYPENDNTKYNEKFKD

SEQ ID NO: 5846 - DNA, 51 bp, Artificial Sequence
  Description of Artificial Sequence: Synthetic Heavy chain variable region CDR H2 nucleic acid sequence
tggatctaccctgaaaatgataacacaaagtacaacgagaagttcaaggac

SEQ ID NO: 5847 - protein, 12 aa, Artificial Sequence
  Description of Artificial Sequence: Synthetic Heavy chain variable region CDR H3 amino acid sequence
ARDGYSRYYFDY

SEQ ID NO: 5848 - DNA, 36 bp, Artificial Sequence
  Description of Artificial Sequence: Synthetic Heavy chain variable region CDR H3 nucleic acid sequence
gccagggacggatattctagatattactttgactac

SEQ ID NO: 5849 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccagaaagaactacttagcttggtaccagcagaaaccaggacagtctcctaagctgctcatttactggacatctacccggaagtccggggtccctgaccgattcagtggcagcgggtctgggacagatttcactctcaccatcagcagcctgcaggctgaagatgtggcagtttattactgtaagcaaagcttcatccttaggacgttcggccaagggaccaaggtggaaatcaaa

SEQ ID NO: 5850 - protein, 112 aa, Artificial Sequence
  Description of Artificial Sequence: Synthetic Light chain variable region amino acid sequence
DIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIK

SEQ ID NO: 5851 - protein, 17 aa, Artificial Sequence
  Description of Artificial Sequence: Synthetic Light chain variable region CDR L1 amino acid sequence
KSSQSLLNSRTRKNYLA

SEQ ID NO: 5852 - DNA, 51 bp, Artificial Sequence; identical to SEQ ID NO: 2988
  Description of Artificial Sequence: Synthetic Light chain variable region CDR L1 nucleic acid sequence

SEQ ID NO: 5853 - protein, 7 aa, Artificial Sequence
  Description of Artificial Sequence: Synthetic Light chain variable region CDR L2 amino acid sequence
WTSTRKS

SEQ ID NO: 5854 - DNA, 21 bp, Artificial Sequence
  Description of Artificial Sequence: Synthetic Light chain variable region CDR L2 nucleic acid sequence
tggacatctacccggaagtcc

SEQ ID NO: 5855 - protein, 8 aa, Artificial Sequence
  Description of Artificial Sequence: Synthetic Light chain variable region CDR L3 amino acid sequence
KQSFILRT

SEQ ID NO: 5856 - DNA, 24 bp, Artificial Sequence
  Description of Artificial Sequence: Synthetic Light chain variable region CDR L3 nucleic acid sequence
aagcaaagcttcatccttaggacg

SEQ ID NO: 5857 - DNA, 369 bp, Artificial Sequence
  Description of Artificial Sequence: Synthetic Heavy chain variable region nucleic acid sequence
gaagtgcagctggtggagtctgggggaggcttggtacagcctggcaggtccctgagactctcctgtgcagcctctggattcacctttgatgattataccatgcactgggtccggcaagctccagggaagggcctggagtgggtctcaggtattagttggaatagtggtagcataggctatgcggactctgtgaagggccgattcaccatctccagagacaacgccaagaagtccctgtatctgcaaatgaacagtctgagagctgaggacacggcgttgtactactgcgccaaggacaattccggatacggccactactactacggtatggacgtctgggggcaagggaccacggtcaccgtcgcctca

SEQ ID NO: 5858 - protein, 123 aa, Artificial Sequence
  Description of Artificial Sequence: Synthetic Heavy chain variable region amino acid sequence
EVQLVESGGGLVQPGRSLRLSCAASGFTFDDYTMHWVRQAPGKGLEWVSGISWNSGSIGYADSVKGRFTISRDNAKKSLYLQMNSLRAEDTALYYCAKDNSGYGHYYYGMDVWGQGTTVTVAS

SEQ ID NO: 5859 - protein, 9 aa, Artificial Sequence
  Description of Artificial Sequence: Synthetic Heavy chain variable region CDR H1 amino acid sequence
FTFDDYTMH

SEQ ID NO: 5860 - DNA, 27 bp, Artificial Sequence
  Description of Artificial Sequence: Synthetic Heavy chain variable region CDR H1 nucleic acid sequence
ttcacctttgatgattataccatgcac

SEQ ID NO: 5861 - protein, 17 aa, Artificial Sequence
  Description of Artificial Sequence: Synthetic Heavy chain variable region CDR H2 amino acid sequence
GISWNSGSIGYADSVKG

SEQ ID NO: 5862 - DNA, 51 bp, Artificial Sequence
  Description of Artificial Sequence: Synthetic Heavy chain variable region CDR H2 nucleic acid sequence
ggtattagttggaatagtggtagcataggctatgcggactctgtgaagggc

SEQ ID NO: 5863 - protein, 16 aa, Artificial Sequence
  Description of Artificial Sequence: Synthetic Heavy chain variable region CDR H3 amino acid sequence
AKDNSGYGHYYYGMDV

SEQ ID NO: 5864 - DNA, 48 bp, Artificial Sequence
  Description of Artificial Sequence: Synthetic Heavy chain variable region CDR H3 nucleic acid sequence
gccaaggacaattccggatacggccactactactacggtatggacgtc

SEQ ID NO: 5865 - DNA, 321 bp, Artificial Sequence
  Description of Artificial Sequence: Synthetic Light chain variable region nucleic acid sequence
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcaacattacatcaattggcctctcactttcggcggagggaccaaggtggagatcaaa

SEQ ID NO: 5866 - protein, 107 aa, Artificial Sequence
  Description of Artificial Sequence: Synthetic Light chain variable region amino acid sequence
EIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 5867 - protein, 11 aa, Artificial Sequence
  Description of Artificial Sequence: Synthetic Light chain variable region CDR L1 amino acid sequence
RASQSVSSNLA

SEQ ID NO: 5868 - DNA, 33 bp, Artificial Sequence
  Description of Artificial Sequence: Synthetic Light chain variable region CDR L1 nucleic acid sequence
agggccagtcagagtgttagcagcaacttagcc

SEQ ID NO: 5869 - protein, 7 aa, Artificial Sequence
  Description of Artificial Sequence: Synthetic Light chain variable region CDR L2 amino acid sequence
GASTRAT

SEQ ID NO: 5870 - DNA, 21 bp, Artificial Sequence
  Description of Artificial Sequence: Synthetic Light chain variable region CDR L2 nucleic acid sequence
ggtgcatccaccagggccact

SEQ ID NO: 5871 - protein, 9 aa, Artificial Sequence
  Description of Artificial Sequence: Synthetic Light chain variable region CDR L3 amino acid sequence
QHYINWPLT

SEQ ID NO: 5872 - DNA, 27 bp, Artificial Sequence
  Description of Artificial Sequence: Synthetic Light chain variable region CDR L3 nucleic acid sequence
caacattacatcaattggcctctcact

SEQ ID NO: 5873 - DNA, 369 bp, Artificial Sequence
  Description of Artificial Sequence: Synthetic Heavy chain variable region nucleic acid sequence
gaagtgcagctggtggagtctgggggaggcttggtacagcctggcggatccctgagactctcctgtgcagccactggattcacctttgatgatttcaccatgcactgggtccggcaagctccagggaagggcctggagtgggtctcaggtattagttggaatagtggtagcataggctatgtggactctgtgaagggccgattcaccatctccagagacaacgccaagaactccctgtatctgcaaatgaacagtctgagagctgaggacacggcgttgtactactgcgccaaggacaacagcggatacggctactactactacggtatggacgtctgggggcaagggaccacggtcaccgtctcctca

SEQ ID NO: 5874 - protein, 123 aa, Artificial Sequence
  Description of Artificial Sequence: Synthetic Heavy chain variable region amino acid sequence
EVQLVESGGGLVQPGGSLRLSCAATGFTFDDFTMHWVRQAPGKGLEWVSGISWNSGSIGYVDSVKGRFTISRDNAKNSLYLQMNSLRAEDTALYYCAKDNSGYGYYYYGMDVWGQGTTVTVSS

SEQ ID NO: 5875 - protein, 9 aa, Artificial Sequence
  Description of Artificial Sequence: Synthetic Heavy chain variable region CDR H1 amino acid sequence
FTFDDFTMH

SEQ ID NO: 5876 - DNA, 27 bp, Artificial Sequence
  Description of Artificial Sequence: Synthetic Heavy chain variable region CDR H1 nucleic acid sequence
ttcacctttgatgatttcaccatgcac

SEQ ID NO: 5877 - protein, 17 aa, Artificial Sequence
  Description of Artificial Sequence: Synthetic Heavy chain variable region CDR H2 amino acid sequence
GISWNSGSIGYVDSVKG

SEQ ID NO: 5878 - DNA, 51 bp, Artificial Sequence
  Description of Artificial Sequence: Synthetic Heavy chain variable region CDR H2 nucleic acid sequence
ggtattagttggaatagtggtagcataggctatgtggactctgtgaagggc

SEQ ID NO: 5879 - protein, 16 aa, Artificial Sequence
  Description of Artificial Sequence: Synthetic Heavy chain variable region CDR H3 amino acid sequence
AKDNSGYGYYYYGMDV

SEQ ID NO: 5880 - DNA, 48 bp, Artificial Sequence
  Description of Artificial Sequence: Synthetic Heavy chain variable region CDR H3 nucleic acid sequence
gccaaggacaacagcggatacggctactactactacggtatggacgtc

SEQ ID NO: 5881 - DNA, 321 bp, Artificial Sequence
  Description of Artificial Sequence: Synthetic Light chain variable region nucleic acid sequence
gaaatagtgatgacgcagtctccagccaccctgtctgtgtctccaggggaaagagccaccctctcctgcagggccagtcacagtgttagcagaaactcagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcaatttattactgtcaacagtataataattggccgctcactttcggcggagggaccaaggtggagatcaaa

SEQ ID NO: 5882 - protein, 107 aa, Artificial Sequence
  Description of Artificial Sequence: Synthetic Light chain variable region amino acid sequence
EIVMTQSPATLSVSPGERATLSCRASHSVSRNSAWYQQKPGQAPRLLIYGASTRATGIPARFSGSGSGTEFTLTISSLQSEDFAIYYCQQYNNWPLTFGGGTKVEIK

SEQ ID NO: 5883 - protein, 11 aa, Artificial Sequence
  Description of Artificial Sequence: Synthetic Light chain variable region CDR L1 amino acid sequence
RASHSVSRNSA

SEQ ID NO: 5884 - DNA, 33 bp, Artificial Sequence
  Description of Artificial Sequence: Synthetic Light chain variable region CDR L1 nucleic acid sequence
agggccagtcacagtgttagcagaaactcagcc

SEQ ID NO: 5885 - protein, 7 aa, Artificial Sequence
  Description of Artificial Sequence: Synthetic Light chain variable region CDR L2 amino acid sequence
GASTRAT

SEQ ID NO: 5886 - DNA, 21 bp, Artificial Sequence
  Description of Artificial Sequence: Synthetic Light chain variable region CDR L2 nucleic acid sequence
ggtgcatccaccagggccact

SEQ ID NO: 5887 - protein, 9 aa, Artificial Sequence
  Description of Artificial Sequence: Synthetic Light chain variable region CDR L3 amino acid sequence
QQYNNWPLT

SEQ ID NO: 5888 - DNA, 27 bp, Artificial Sequence
  Description of Artificial Sequence: Synthetic Light chain variable region CDR L3 nucleic acid sequence
caacagtataataattggccgctcact

SEQ ID NO: 5889 - DNA, 354 bp, Artificial Sequence
  Description of Artificial Sequence: Synthetic Heavy chain variable region nucleic acid sequence
caggtgcagctggtggagtctgggggaggcgtggtccagcctgggaggtccctgagactctcctgtgcagcgtctggattcaccttcagaagctatgccatgcactgggtccgccaggctccaggcaaggggctggagtgggtggcaatggtatactatgatggaaataatcaatactatgcagactccgtgaggggccgattcaccatctccagagacaattccaagaacacgctgtatctgcaaatgaacagcctgagagccgacgacacggcggtgtacttctgcgctagaggtcctggctataactggttggacccctggggccagggaaccctggtcaccgtctcctca

SEQ ID NO: 5890 - protein, 118 aa, Artificial Sequence
  Description of Artificial Sequence: Synthetic Heavy chain variable region amino acid sequence
QVQLVESGGGVVQPGRSLRLSCAASGFTFRSYAMHWVRQAPGKGLEWVAMVYYDGNNQYYADSVRGRFTISRDNSKNTLYLQMNSLRADDTAVYFCARGPGYNWLDPWGQGTLVTVSS

SEQ ID NO: 5891 - protein, 9 aa, Artificial Sequence
  Description of Artificial Sequence: Synthetic Heavy chain variable region CDR H1 amino acid sequence
FTFRSYAMH

SEQ ID NO: 5892 - DNA, 27 bp, Artificial Sequence
  Description of Artificial Sequence: Synthetic Heavy chain variable region CDR H1 nucleic acid sequence
ttcaccttcagaagctatgccatgcac

SEQ ID NO: 5893 - protein, 17 aa, Artificial Sequence
  Description of Artificial Sequence: Synthetic Heavy chain variable region CDR H2 amino acid sequence
MVYYDGNNQYYADSVRG

SEQ ID NO: 5894 - DNA, 51 bp, Artificial Sequence
  Description of Artificial Sequence: Synthetic Heavy chain variable region CDR H2 nucleic acid sequence
atggtatactatgatggaaataatcaatactatgcagactccgtgaggggc

SEQ ID NO: 5895 - protein, 11 aa, Artificial Sequence
  Description of Artificial Sequence: Synthetic Heavy chain variable region CDR H3 amino acid sequence
ARGPGYNWLDP

SEQ ID NO: 5896 - DNA, 33 bp, Artificial Sequence
  Description of Artificial Sequence: Synthetic Heavy chain variable region CDR H3 nucleic acid sequence
gctagaggtcctggctataactggttggacccc

SEQ ID NO: 5897 - DNA, 321 bp, Artificial Sequence
  Description of Artificial Sequence: Synthetic Light chain variable region nucleic acid sequence
gaaatagtgatgacgcagtctccagccaccctgtctgtgtctccaggggaaagagccaccctctcctgcagggccagtcagagtgttagcagaaacttagcctggtaccagcagaaacctggccaggctcccaggctcctcatctatggtgcatccaccagggccactggtatcccagccaggttcagtggcagtgggtctgggacagacttcactctcaccatcagcagcctgcagtctgaagattttgcagtttattactgtcaacagtacaacaattggcctctcactttcggcggagggaccaaggtggtgatcaaa

SEQ ID NO: 5898 - protein, 107 aa, Artificial Sequence
  Description of Artificial Sequence: Synthetic Light chain variable region amino acid sequence
EIVMTQSPATLSVSPGERATLSCRASQSVSRNLAWYQQKPGQAPRLLIYGASTRATGIPARFSGSGSGTDFTLTISSLQSEDFAVYYCQQYNNWPLTFGGGTKVVIK

SEQ ID NO: 5899 - protein, 11 aa, Artificial Sequence
  Description of Artificial Sequence: Synthetic Light chain variable region CDR L1 amino acid sequence
RASQSVSRNLA

SEQ ID NO: 5900 - DNA, 33 bp, Artificial Sequence
  Description of Artificial Sequence: Synthetic Light chain variable region CDR L1 nucleic acid sequence
agggccagtcagagtgttagcagaaacttagcc

SEQ ID NO: 5901 - protein, 7 aa, Artificial Sequence
  Description of Artificial Sequence: Synthetic Light chain variable region CDR L2 amino acid sequence
GASTRAT

SEQ ID NO: 5902 - DNA, 21 bp, Artificial Sequence
  Description of Artificial Sequence: Synthetic Light chain variable region CDR L2 nucleic acid sequence
ggtgcatccaccagggccact

SEQ ID NO: 5903 - protein, 9 aa, Artificial Sequence
  Description of Artificial Sequence: Synthetic Light chain variable region CDR L3 amino acid sequence
QQYNNWPLT

SEQ ID NO: 5904 - DNA, 27 bp, Artificial Sequence
  Description of Artificial Sequence: Synthetic Light chain variable region CDR L3 nucleic acid sequence
caacagtacaacaattggcctctcact

SEQ ID NO: 5905 - DNA, 354 bp, Artificial Sequence
  Description of Artificial Sequence: Synthetic Heavy chain variable region nucleic acid sequence
caggtgcagctggtggagtctgggggaggcgtggtccagcctgggaggtccctgagactcgcctgtgtagcgtctggattcaccttcagaagctatggcatgcactgggtccgccaggctccaggcaaggggctgcagtgggtggcaatgatatactatgatggaaagaataaatactatgcagactccgtgaggggccgattcaccatctccagagacaattccaagaacacgctgtatctgcaaatgaacaacctgagagtcgaggacacggcgatgtacttctgcgccagaggtccaggctataactggttggacccctggggccagggaaccctggtcaccgtctcctca

SEQ ID NO: 5906 - protein, 118 aa, Artificial Sequence
  Description of Artificial Sequence: Synthetic Heavy chain variable region amino acid sequence
QVQLVESGGGVVQPGRSLRLACVASGFTFRSYGMHWVRQAPGKGLQWVAMIYYDGKNKYYADSVRGRFTISRDNSKNTLYLQMNNLRVEDTAMYFCARGPGYNWLDPWGQGTLVTVSS

SEQ ID NO: 5907 - protein, 9 aa, Artificial Sequence
  Description of Artificial Sequence: Synthetic Heavy chain variable region CDR H1 amino acid sequence
FTFRSYGMH

SEQ ID NO: 5908 - DNA, 27 bp, Artificial Sequence
  Description of Artificial Sequence: Synthetic Heavy chain variable region CDR H1 nucleic acid sequence
ttcaccttcagaagctatggcatgcac

SEQ ID NO: 5909 - protein, 17 aa, Artificial Sequence
  Description of Artificial Sequence: Synthetic Heavy chain variable region CDR H2 amino acid sequence
MIYYDGKNKYYADSVRG

SEQ ID NO: 5910 - DNA, 51 bp, Artificial Sequence
  Description of Artificial Sequence: Synthetic Heavy chain variable region CDR H2 nucleic acid sequence
atgatatactatgatggaaagaataaatactatgcagactccgtgaggggc

SEQ ID NO: 5911 - protein, 11 aa, Artificial Sequence
  Description of Artificial Sequence: Synthetic Heavy chain variable region CDR H3 amino acid sequence
ARGPGYNWLDP

SEQ ID NO: 5912 - DNA, 33 bp, Artificial Sequence
  Description of Artificial Sequence: Synthetic Heavy chain variable region CDR H3 nucleic acid sequence
gccagaggtccaggctataactggttggacccc

SEQ ID NO: 5913 - DNA, 321 bp, Artificial Sequence
  Description of Artificial Sequence: Synthetic Light chain variable region nucleic acid sequence
gaaatagtgatgacgcagtctccagccaccctgtctgtgtctccaggggaaagagccaccctctcctgcagggccagtcagagaattagcagcaacttagcctggtaccagcagaaacctggccaggctcccaggctcctcatctatggtgcatccaccagggccactggtagcccagccaggttcagtggcagtgggtctgggacagacttcactctcaccatcagcagcctgcagtctgaagatgttgcagtttattactgtcagcagcatcataactggcctctcactttcggcggagggaccaaggtggagatcaaa

SEQ ID NO: 5914 - protein, 107 aa, Artificial Sequence
  Description of Artificial Sequence: Synthetic Light chain variable region amino acid sequence
EIVMTQSPATLSVSPGERATLSCRASQRISSNLAWYQQKPGQAPRLLIYGASTRATGSPARFSGSGSGTDFTLTISSLQSEDVAVYYCQQHHNWPLTFGGGTKVEIK

SEQ ID NO: 5915 - protein, 11 aa, Artificial Sequence
  Description of Artificial Sequence: Synthetic Light chain variable region CDR L1 amino acid sequence
RASQRISSNLA

SEQ ID NO: 5916 - DNA, 33 bp, Artificial Sequence
  Description of Artificial Sequence: Synthetic Light chain variable region CDR L1 nucleic acid sequence
agggccagtcagagaattagcagcaacttagcc

SEQ ID NO: 5917 - protein, 7 aa, Artificial Sequence
  Description of Artificial Sequence: Synthetic Light chain variable region CDR L2 amino acid sequence
GASTRAT

SEQ ID NO: 5918 - DNA, 21 bp, Artificial Sequence
  Description of Artificial Sequence: Synthetic Light chain variable region CDR L2 nucleic acid sequence
ggtgcatccaccagggccact

SEQ ID NO: 5919 - protein, 9 aa, Artificial Sequence
  Description of Artificial Sequence: Synthetic Light chain variable region CDR L3 amino acid sequence
QQHHNWPLT

SEQ ID NO: 5920 - DNA, 27 bp, Artificial Sequence
  Description of Artificial Sequence: Synthetic Light chain variable region CDR L3 nucleic acid sequence
cagcagcatcataactggcctctcact

SEQ ID NO: 5921 - DNA, 375 bp, Artificial Sequence; identical to SEQ ID NO: 1
  Description of Artificial Sequence: Synthetic Heavy chain variable region nucleic acid sequence

SEQ ID NO: 5922 - protein, 125 aa, Artificial Sequence; identical to SEQ ID NO: 2
  Description of Artificial Sequence: Synthetic Heavy chain variable region amino acid sequence

SEQ ID NO: 5923 - protein, 9 aa, Artificial Sequence
  Description of Artificial Sequence: Synthetic Heavy chain variable region CDR H1 amino acid sequence
FTFNTYAMN

SEQ ID NO: 5924 - DNA, 27 bp, Artificial Sequence
  Description of Artificial Sequence: Synthetic Heavy chain variable region CDR H1 nucleic acid sequence
ttcacctttaacacatatgccatgaat

SEQ ID NO: 5925 - protein, 19 aa, Artificial Sequence
  Description of Artificial Sequence: Synthetic Heavy chain variable region CDR H2 amino acid sequence
RIRSKYNNYATYYADSVKD

SEQ ID NO: 5926 - DNA, 57 bp, Artificial Sequence; identical to SEQ ID NO: 6
  Description of Artificial Sequence: Synthetic Heavy chain variable region CDR H2 nucleic acid sequence

SEQ ID NO: 5927 - protein, 16 aa, Artificial Sequence
  Description of Artificial Sequence: Synthetic Heavy chain variable region CDR H3 amino acid sequence
VRHGNFGNSYVSWFAY

SEQ ID NO: 5928 - DNA, 48 bp, Artificial Sequence; identical to SEQ ID NO: 8
  Description of Artificial Sequence: Synthetic Heavy chain variable region CDR H3 nucleic acid sequence

SEQ ID NO: 5929 - DNA, 327 bp, Artificial Sequence; identical to SEQ ID NO: 9
  Description of Artificial Sequence: Synthetic Light chain variable region nucleic acid sequence

SEQ ID NO: 5930 - protein, 109 aa, Artificial Sequence; identical to SEQ ID NO: 10
  Description of Artificial Sequence: Synthetic Light chain variable region amino acid sequence

SEQ ID NO: 5931 - protein, 14 aa, Artificial Sequence
  Description of Artificial Sequence: Synthetic Light chain variable region CDR L1 amino acid sequence
RSSTGAVTTSNYAN

SEQ ID NO: 5932 - DNA, 42 bp, Artificial Sequence; identical to SEQ ID NO: 12
  Description of Artificial Sequence: Synthetic Light chain variable region CDR L1 nucleic acid sequence

SEQ ID NO: 5933 - protein, 7 aa, Artificial Sequence
  Description of Artificial Sequence: Synthetic Light chain variable region CDR L2 amino acid sequence
GTNKRAP

SEQ ID NO: 5934 - DNA, 21 bp, Artificial Sequence
  Description of Artificial Sequence: Synthetic Light chain variable region CDR L2 nucleic acid sequence
ggcacaaacaagcgcgctcct

SEQ ID NO: 5935 - protein, 9 aa, Artificial Sequence
  Description of Artificial Sequence: Synthetic Light chain variable region CDR L3 amino acid sequence
ALWYSNLWV

SEQ ID NO: 5936 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 5937 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatattactttgatgtgtggggccaaggaaccctggtcaccgtctcctca

SEQ ID NO: 5938 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYARYYFDVWGQGTLVTVSS

SEQ ID NO: 5939 - protein, 9 aa, Artificial Sequence
  Description of Artificial Sequence: Synthetic Heavy chain variable region CDR H1 amino acid sequence
FNIKDYYMH

SEQ ID NO: 5940 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5941 - protein, 17 aa, Artificial Sequence
  Description of Artificial Sequence: Synthetic Heavy chain variable region CDR H2 amino acid sequence
WIDLENGNTIYDPKFQG

SEQ ID NO: 5942 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5943 - protein, 12 aa, Artificial Sequence
  Description of Artificial Sequence: Synthetic Heavy chain variable region CDR H3 amino acid sequence
ARDGYARYYFDV

SEQ ID NO: 5944 - DNA, 36 bp, Artificial Sequence
  Description of Artificial Sequence: Synthetic Heavy chain variable region CDR H3 nucleic acid sequence
gcgagagatggatacgctagatattactttgatgtg

SEQ ID NO: 5945 - DNA, 336 bp, Artificial Sequence; identical to SEQ ID NO: 3865
  Description of Artificial Sequence: Synthetic Light chain variable region nucleic acid sequence

SEQ ID NO: 5946 - protein, 112 aa, Artificial Sequence; identical to SEQ ID NO: 3866
  Description of Artificial Sequence: Synthetic Light chain variable region amino acid sequence

SEQ ID NO: 5947 - protein, 17 aa, Artificial Sequence
  Description of Artificial Sequence: Synthetic Light chain variable region CDR L1 amino acid sequence
KSSQSLLNSRTGKNYLA

SEQ ID NO: 5948 - DNA, 51 bp, Artificial Sequence; identical to SEQ ID NO: 3868
  Description of Artificial Sequence: Synthetic Light chain variable region CDR L1 nucleic acid sequence

SEQ ID NO: 5949 - protein, 7 aa, Artificial Sequence
  Description of Artificial Sequence: Synthetic Light chain variable region CDR L2 amino acid sequence
WASTRES

SEQ ID NO: 5950 - DNA, 21 bp, Artificial Sequence
  Description of Artificial Sequence: Synthetic Light chain variable region CDR L2 nucleic acid sequence
tgggcatctacccgggaatcc

SEQ ID NO: 5951 - protein, 8 aa, Artificial Sequence
  Description of Artificial Sequence: Synthetic Light chain variable region CDR L3 amino acid sequence
KQSYSRRT

SEQ ID NO: 5952 - DNA, 24 bp, Artificial Sequence
  Description of Artificial Sequence: Synthetic Light chain variable region CDR L3 nucleic acid sequence
aagcaatcttattctcggagaact

SEQ ID NO: 5953 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatattactatgactactggggccaaggaaccctggtcaccgtctcctca

SEQ ID NO: 5954 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYARYYYDYWGQGTLVTVSS

SEQ ID NO: 5955 - protein, 9 aa, Artificial Sequence
  Description of Artificial Sequence: Synthetic Heavy chain variable region CDR H1 amino acid sequence
FNIKDYYMH

SEQ ID NO: 5956 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5957 - protein, 17 aa, Artificial Sequence
  Description of Artificial Sequence: Synthetic Heavy chain variable region CDR H2 amino acid sequence
WIDLENGNTIYDPKFQG

SEQ ID NO: 5958 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5959 - protein, 12 aa, Artificial Sequence
  Description of Artificial Sequence: Synthetic Heavy chain variable region CDR H3 amino acid sequence
ARDGYARYYYDY

SEQ ID NO: 5960 - DNA, 36 bp, Artificial Sequence
  Description of Artificial Sequence: Synthetic Heavy chain variable region CDR H3 nucleic acid sequence
gcgagagatggatacgctagatattactatgactac

SEQ ID NO: 5961 - DNA, 336 bp, Artificial Sequence; identical to SEQ ID NO: 3865
  Description of Artificial Sequence: Synthetic Light chain variable region nucleic acid sequence

SEQ ID NO: 5962 - protein, 112 aa, Artificial Sequence; identical to SEQ ID NO: 3866
  Description of Artificial Sequence: Synthetic Light chain variable region amino acid sequence

SEQ ID NO: 5963 - protein, 17 aa, Artificial Sequence
  Description of Artificial Sequence: Synthetic Light chain variable region CDR L1 amino acid sequence
KSSQSLLNSRTGKNYLA

SEQ ID NO: 5964 - DNA, 51 bp, Artificial Sequence; identical to SEQ ID NO: 3868
  Description of Artificial Sequence: Synthetic Light chain variable region CDR L1 nucleic acid sequence

SEQ ID NO: 5965 - protein, 7 aa, Artificial Sequence
  Description of Artificial Sequence: Synthetic Light chain variable region CDR L2 amino acid sequence
WASTRES

SEQ ID NO: 5966 - DNA, 21 bp, Artificial Sequence
  Description of Artificial Sequence: Synthetic Light chain variable region CDR L2 nucleic acid sequence
tgggcatctacccgggaatcc

SEQ ID NO: 5967 - protein, 8 aa, Artificial Sequence
  Description of Artificial Sequence: Synthetic Light chain variable region CDR L3 amino acid sequence
KQSYSRRT

SEQ ID NO: 5968 - DNA, 24 bp, Artificial Sequence
  Description of Artificial Sequence: Synthetic Light chain variable region CDR L3 nucleic acid sequence
aagcaatcttattctcggagaact

SEQ ID NO: 5969 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcagtagagatggatacgctagatattactttgactactggggccaaggaaccctggtcaccgtctcctca

SEQ ID NO: 5970 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCSRDGYARYYFDYWGQGTLVTVSS

SEQ ID NO: 5971 - protein, 9 aa, Artificial Sequence
  Description of Artificial Sequence: Synthetic Heavy chain variable region CDR H1 amino acid sequence
FNIKDYYMH

SEQ ID NO: 5972 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5973 - protein, 17 aa, Artificial Sequence
  Description of Artificial Sequence: Synthetic Heavy chain variable region CDR H2 amino acid sequence
WIDLENGNTIYDPKFQG

SEQ ID NO: 5974 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5975 - protein, 12 aa, Artificial Sequence
  Description of Artificial Sequence: Synthetic Heavy chain variable region CDR H3 amino acid sequence
SRDGYARYYFDY

SEQ ID NO: 5976 - DNA, 36 bp, Artificial Sequence
  Description of Artificial Sequence: Synthetic Heavy chain variable region CDR H3 nucleic acid sequence
agtagagatggatacgctagatattactttgactac

SEQ ID NO: 5977 - DNA, 336 bp, Artificial Sequence; identical to SEQ ID NO: 3865
  Description of Artificial Sequence: Synthetic Light chain variable region nucleic acid sequence

SEQ ID NO: 5978 - protein, 112 aa, Artificial Sequence; identical to SEQ ID NO: 3866
  Description of Artificial Sequence: Synthetic Light chain variable region amino acid sequence

SEQ ID NO: 5979 - protein, 17 aa, Artificial Sequence
  Description of Artificial Sequence: Synthetic Light chain variable region CDR L1 amino acid sequence
KSSQSLLNSRTGKNYLA

SEQ ID NO: 5980 - DNA, 51 bp, Artificial Sequence; identical to SEQ ID NO: 3868
  Description of Artificial Sequence: Synthetic Light chain variable region CDR L1 nucleic acid sequence

SEQ ID NO: 5981 - protein, 7 aa, Artificial Sequence
  Description of Artificial Sequence: Synthetic Light chain variable region CDR L2 amino acid sequence
WASTRES

SEQ ID NO: 5982 - DNA, 21 bp, Artificial Sequence
  Description of Artificial Sequence: Synthetic Light chain variable region CDR L2 nucleic acid sequence
tgggcatctacccgggaatcc

SEQ ID NO: 5983 - protein, 8 aa, Artificial Sequence
  Description of Artificial Sequence: Synthetic Light chain variable region CDR L3 amino acid sequence
KQSYSRRT

SEQ ID NO: 5984 - DNA, 24 bp, Artificial Sequence
  Description of Artificial Sequence: Synthetic Light chain variable region CDR L3 nucleic acid sequence
aagcaatcttattctcggagaact

SEQ ID NO: 5985 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcaatagagatggatacgctagatattactatgactactggggccaaggaaccctggtcaccgtctcctca

SEQ ID NO: 5986 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCNRDGYARYYYDYWGQGTLVTVSS

SEQ ID NO: 5987 - protein, 9 aa, Artificial Sequence
  Description of Artificial Sequence: Synthetic Heavy chain variable region CDR H1 amino acid sequence
FNIKDYYMH

SEQ ID NO: 5988 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 5989 - protein, 17 aa, Artificial Sequence
  Description of Artificial Sequence: Synthetic Heavy chain variable region CDR H2 amino acid sequence
WIDLENGNTIYDPKFQG

SEQ ID NO: 5990 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 5991 - protein, 12 aa, Artificial Sequence
  Description of Artificial Sequence: Synthetic Heavy chain variable region CDR H3 amino acid sequence
NRDGYARYYYDY

SEQ ID NO: 5992 - DNA, 36 bp, Artificial Sequence
  Description of Artificial Sequence: Synthetic Heavy chain variable region CDR H3 nucleic acid sequence
aatagagatggatacgctagatattactatgactac

SEQ ID NO: 5993 - DNA, 336 bp, Artificial Sequence; identical to SEQ ID NO: 3865
  Description of Artificial Sequence: Synthetic Light chain variable region nucleic acid sequence

SEQ ID NO: 5994 - protein, 112 aa, Artificial Sequence; identical to SEQ ID NO: 3866
  Description of Artificial Sequence: Synthetic Light chain variable region amino acid sequence

SEQ ID NO: 5995 - protein, 17 aa, Artificial Sequence
  Description of Artificial Sequence: Synthetic Light chain variable region CDR L1 amino acid sequence
KSSQSLLNSRTGKNYLA

SEQ ID NO: 5996 - DNA, 51 bp, Artificial Sequence; identical to SEQ ID NO: 3868
  Description of Artificial Sequence: Synthetic Light chain variable region CDR L1 nucleic acid sequence

SEQ ID NO: 5997 - protein, 7 aa, Artificial Sequence
  Description of Artificial Sequence: Synthetic Light chain variable region CDR L2 amino acid sequence
WASTRES

SEQ ID NO: 5998 - DNA, 21 bp, Artificial Sequence
  Description of Artificial Sequence: Synthetic Light chain variable region CDR L2 nucleic acid sequence
tgggcatctacccgggaatcc

SEQ ID NO: 5999 - protein, 8 aa, Artificial Sequence
  Description of Artificial Sequence: Synthetic Light chain variable region CDR L3 amino acid sequence
KQSYSRRT

SEQ ID NO: 6000 - DNA, 24 bp, Artificial Sequence
  Description of Artificial Sequence: Synthetic Light chain variable region CDR L3 nucleic acid sequence
aagcaatcttattctcggagaact

SEQ ID NO: 6001 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatggatacgctagatatttttttgacaattggggccaaggaaccctggtcaccgtctcctca

SEQ ID NO: 6002 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYARYFFDNWGQGTLVTVSS

SEQ ID NO: 6003 - protein, 9 aa, Artificial Sequence
  Description of Artificial Sequence: Synthetic Heavy chain variable region CDR H1 amino acid sequence
FNIKDYYMH

SEQ ID NO: 6004 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6005 - protein, 17 aa, Artificial Sequence
  Description of Artificial Sequence: Synthetic Heavy chain variable region CDR H2 amino acid sequence
WIDLENGNTIYDPKFQG

SEQ ID NO: 6006 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 6007 - protein, 12 aa, Artificial Sequence
  Description of Artificial Sequence: Synthetic Heavy chain variable region CDR H3 amino acid sequence
ARDGYARYFFDN

SEQ ID NO: 6008 - DNA, 36 bp, Artificial Sequence
  Description of Artificial Sequence: Synthetic Heavy chain variable region CDR H3 nucleic acid sequence
gcgagagatggatacgctagatatttttttgacaat

SEQ ID NO: 6009 - DNA, 336 bp, Artificial Sequence; identical to SEQ ID NO: 3865
  Description of Artificial Sequence: Synthetic Light chain variable region nucleic acid sequence

SEQ ID NO: 6010 - protein, 112 aa, Artificial Sequence; identical to SEQ ID NO: 3866
  Description of Artificial Sequence: Synthetic Light chain variable region amino acid sequence

SEQ ID NO: 6011 - protein, 17 aa, Artificial Sequence
  Description of Artificial Sequence: Synthetic Light chain variable region CDR L1 amino acid sequence
KSSQSLLNSRTGKNYLA

SEQ ID NO: 6012 - DNA, 51 bp, Artificial Sequence; identical to SEQ ID NO: 3868
  Description of Artificial Sequence: Synthetic Light chain variable region CDR L1 nucleic acid sequence

SEQ ID NO: 6013 - protein, 7 aa, Artificial Sequence
  Description of Artificial Sequence: Synthetic Light chain variable region CDR L2 amino acid sequence
WASTRES

SEQ ID NO: 6014 - DNA, 21 bp, Artificial Sequence
  Description of Artificial Sequence: Synthetic Light chain variable region CDR L2 nucleic acid sequence
tgggcatctacccgggaatcc

SEQ ID NO: 6015 - protein, 8 aa, Artificial Sequence
  Description of Artificial Sequence: Synthetic Light chain variable region CDR L3 amino acid sequence
KQSYSRRT

SEQ ID NO: 6016 - DNA, 24 bp, Artificial Sequence
  Description of Artificial Sequence: Synthetic Light chain variable region CDR L3 nucleic acid sequence
aagcaatcttattctcggagaact

SEQ ID NO: 6017 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgcgagagatgggtacgggagatattactttgaccgttggggccaaggaaccctggtcaccgtctcctca

SEQ ID NO: 6018 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCARDGYGRYYFDRWGQGTLVTVSS

SEQ ID NO: 6019 - protein, 9 aa, Artificial Sequence
  Description of Artificial Sequence: Synthetic Heavy chain variable region CDR H1 amino acid sequence
FNIKDYYMH

SEQ ID NO: 6020 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6021 - protein, 17 aa, Artificial Sequence
  Description of Artificial Sequence: Synthetic Heavy chain variable region CDR H2 amino acid sequence
WIDLENGNTIYDPKFQG

SEQ ID NO: 6022 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 6023 - protein, 12 aa, Artificial Sequence
  Description of Artificial Sequence: Synthetic Heavy chain variable region CDR H3 amino acid sequence
ARDGYGRYYFDR

SEQ ID NO: 6024 - DNA, 36 bp, Artificial Sequence
  Description of Artificial Sequence: Synthetic Heavy chain variable region CDR H3 nucleic acid sequence
gcgagagatgggtacgggagatattactttgaccgt

SEQ ID NO: 6025 - DNA, 336 bp, Artificial Sequence
  Description of Artificial Sequence: Synthetic Light chain variable region nucleic acid sequence
gacatcgtgatgacccagtctccagactccctggctgtgtctctgggcgagagggccaccatcaactgcaagtccagccagagtcttttaaacagcagaaccggaaagaactacttagcttggtaccagcagaaaccaggacagccccctaagctgctcatttactgggcatctacccgggaatccggggtccctgaccgattcagtggcagcgggtctgggacagacttcactctcactatcagtagcctgcaggctgaagatgtggcagtttattactgtaagcaatcttattctcggagaactttcggcggagggaccaaggtcgagatcaaa

SEQ ID NO: 6026 - protein, 112 aa, Artificial Sequence; identical to SEQ ID NO: 3866
  Description of Artificial Sequence: Synthetic Light chain variable region amino acid sequence

SEQ ID NO: 6027 - protein, 17 aa, Artificial Sequence
  Description of Artificial Sequence: Synthetic Light chain variable region CDR L1 amino acid sequence
KSSQSLLNSRTGKNYLA

SEQ ID NO: 6028 - DNA, 51 bp, Artificial Sequence; identical to SEQ ID NO: 3868
  Description of Artificial Sequence: Synthetic Light chain variable region CDR L1 nucleic acid sequence

SEQ ID NO: 6029 - protein, 7 aa, Artificial Sequence
  Description of Artificial Sequence: Synthetic Light chain variable region CDR L2 amino acid sequence
WASTRES

SEQ ID NO: 6030 - DNA, 21 bp, Artificial Sequence
  Description of Artificial Sequence: Synthetic Light chain variable region CDR L2 nucleic acid sequence
tgggcatctacccgggaatcc

SEQ ID NO: 6031 - protein, 8 aa, Artificial Sequence
  Description of Artificial Sequence: Synthetic Light chain variable region CDR L3 amino acid sequence
KQSYSRRT

SEQ ID NO: 6032 - DNA, 24 bp, Artificial Sequence
  Description of Artificial Sequence: Synthetic Light chain variable region CDR L3 nucleic acid sequence
aagcaatcttattctcggagaact

SEQ ID NO: 6033 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatggtaacacaatctatgacccgaagtttcagggcagggtcaccataaccagggacacgtccgccagcacagcctacatggagctgagcagcctgagatctgaagacacggcggtgtactactgcgggtcggatggatacgctagatattactttgactactggggccaaggaaccctggtcaccgtctcctca

SEQ ID NO: 6034 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENGNTIYDPKFQGRVTITRDTSASTAYMELSSLRSEDTAVYYCGSDGYARYYFDYWGQGTLVTVSS

SEQ ID NO: 6035 - protein, 9 aa, Artificial Sequence
  Description of Artificial Sequence: Synthetic Heavy chain variable region CDR H1 amino acid sequence
FNIKDYYMH

SEQ ID NO: 6036 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6037 - protein, 17 aa, Artificial Sequence
  Description of Artificial Sequence: Synthetic Heavy chain variable region CDR H2 amino acid sequence
WIDLENGNTIYDPKFQG

SEQ ID NO: 6038 - DNA, 51 bp, Artificial Sequence; identical to SEQ ID NO: 3574
  Description of Artificial Sequence: Synthetic Heavy chain variable region CDR H2 nucleic acid sequence

SEQ ID NO: 6039 - protein, 12 aa, Artificial Sequence
  Description of Artificial Sequence: Synthetic Heavy chain variable region CDR H3 amino acid sequence
GSDGYARYYFDY

SEQ ID NO: 6040 - DNA, 36 bp, Artificial Sequence
  Description of Artificial Sequence: Synthetic Heavy chain variable region CDR H3 nucleic acid sequence
gggtcggatggatacgctagatattactttgactac

SEQ ID NO: 6041 - DNA, 336 bp, Artificial Sequence; identical to SEQ ID NO: 3865
  Description of Artificial Sequence: Synthetic Light chain variable region nucleic acid sequence

SEQ ID NO: 6042 - protein, 112 aa, Artificial Sequence; identical to SEQ ID NO: 3866
  Description of Artificial Sequence: Synthetic Light chain variable region amino acid sequence

SEQ ID NO: 6043 - protein, 17 aa, Artificial Sequence
  Description of Artificial Sequence: Synthetic Light chain variable region CDR L1 amino acid sequence
KSSQSLLNSRTGKNYLA

SEQ ID NO: 6044 - DNA, 51 bp, Artificial Sequence; identical to SEQ ID NO: 3868
  Description of Artificial Sequence: Synthetic Light chain variable region CDR L1 nucleic acid sequence

SEQ ID NO: 6045 - protein, 7 aa, Artificial Sequence
  Description of Artificial Sequence: Synthetic Light chain variable region CDR L2 amino acid sequence
WASTRES

SEQ ID NO: 6046 - DNA, 21 bp, Artificial Sequence
  Description of Artificial Sequence: Synthetic Light chain variable region CDR L2 nucleic acid sequence
tgggcatctacccgggaatcc

SEQ ID NO: 6047 - protein, 8 aa, Artificial Sequence
  Description of Artificial Sequence: Synthetic Light chain variable region CDR L3 amino acid sequence
KQSYSRRT

SEQ ID NO: 6048 - DNA, 24 bp, Artificial Sequence
  Description of Artificial Sequence: Synthetic Light chain variable region CDR L3 nucleic acid sequence
aagcaatcttattctcggagaact

SEQ ID NO: 6049 - DNA, 357 bp, Artificial Sequence; identical to SEQ ID NO: 5201
  Description of Artificial Sequence: Synthetic Heavy chain variable region nucleic acid sequence

SEQ ID NO: 6050 - protein, 119 aa, Artificial Sequence; identical to SEQ ID NO: 5202
  Description of Artificial Sequence: Synthetic Heavy chain variable region amino acid sequence

SEQ ID NO: 6051 - protein, 9 aa, Artificial Sequence
  Description of Artificial Sequence: Synthetic Heavy chain variable region CDR H1 amino acid sequence
FNIKDYYMH

SEQ ID NO: 6052 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6053 - protein, 17 aa, Artificial Sequence
  Description of Artificial Sequence: Synthetic Heavy chain variable region CDR H2 amino acid sequence
WIDLENANTIYDAKFQG

SEQ ID NO: 6054 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6055 - protein, 12 aa, Artificial Sequence
  Description of Artificial Sequence: Synthetic Heavy chain variable region CDR H3 amino acid sequence
GRDAYGRYFYDV

SEQ ID NO: 6056 - DNA, 36 bp, Artificial Sequence; identical to SEQ ID NO: 5208
  Description of Artificial Sequence: Synthetic Heavy chain variable region CDR H3 nucleic acid sequence

SEQ ID NO: 6057 - DNA, 336 bp, Artificial Sequence; identical to SEQ ID NO: 4537
  Description of Artificial Sequence: Synthetic Light chain variable region nucleic acid sequence

SEQ ID NO: 6058 - protein, 112 aa, Artificial Sequence; identical to SEQ ID NO: 4538
  Description of Artificial Sequence: Synthetic Light chain variable region amino acid sequence

SEQ ID NO: 6059 - protein, 17 aa, Artificial Sequence
  Description of Artificial Sequence: Synthetic Light chain variable region CDR L1 amino acid sequence
KSSQSLLNARTGKNYLA

SEQ ID NO: 6060 - DNA, 51 bp, Artificial Sequence; identical to SEQ ID NO: 4540
  Description of Artificial Sequence: Synthetic Light chain variable region CDR L1 nucleic acid sequence

SEQ ID NO: 6061 - protein, 7 aa, Artificial Sequence
  Description of Artificial Sequence: Synthetic Light chain variable region CDR L2 amino acid sequence
WASTRES

SEQ ID NO: 6062 - DNA, 21 bp, Artificial Sequence
  Description of Artificial Sequence: Synthetic Light chain variable region CDR L2 nucleic acid sequence
tgggcatctacccgggaatcc

SEQ ID NO: 6063 - protein, 8 aa, Artificial Sequence
  Description of Artificial Sequence: Synthetic Light chain variable region CDR L3 amino acid sequence
KQSYSRRT

SEQ ID NO: 6064 - DNA, 24 bp, Artificial Sequence
  Description of Artificial Sequence: Synthetic Light chain variable region CDR L3 nucleic acid sequence
aagcaatcttattctcggagaact

SEQ ID NO: 6065 - DNA, 357 bp, Artificial Sequence; identical to SEQ ID NO: 5265
  Description of Artificial Sequence: Synthetic Heavy chain variable region nucleic acid sequence

SEQ ID NO: 6066 - protein, 119 aa, Artificial Sequence; identical to SEQ ID NO: 5266
  Description of Artificial Sequence: Synthetic Heavy chain variable region amino acid sequence

SEQ ID NO: 6067 - protein, 9 aa, Artificial Sequence
  Description of Artificial Sequence: Synthetic Heavy chain variable region CDR H1 amino acid sequence
FNIKDYYMH

SEQ ID NO: 6068 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6069 - protein, 17 aa, Artificial Sequence
  Description of Artificial Sequence: Synthetic Heavy chain variable region CDR H2 amino acid sequence
WIDLENANTIYDAKFQG

SEQ ID NO: 6070 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6071 - protein, 12 aa, Artificial Sequence
  Description of Artificial Sequence: Synthetic Heavy chain variable region CDR H3 amino acid sequence
ARDVLGRYFYDV

SEQ ID NO: 6072 - DNA, 36 bp, Artificial Sequence; identical to SEQ ID NO: 5272
  Description of Artificial Sequence: Synthetic Heavy chain variable region CDR H3 nucleic acid sequence

SEQ ID NO: 6073 - DNA, 336 bp, Artificial Sequence; identical to SEQ ID NO: 4537
  Description of Artificial Sequence: Synthetic Light chain variable region nucleic acid sequence

SEQ ID NO: 6074 - protein, 112 aa, Artificial Sequence; identical to SEQ ID NO: 4538
  Description of Artificial Sequence: Synthetic Light chain variable region amino acid sequence

SEQ ID NO: 6075 - protein, 17 aa, Artificial Sequence
  Description of Artificial Sequence: Synthetic Light chain variable region CDR L1 amino acid sequence
KSSQSLLNARTGKNYLA

SEQ ID NO: 6076 - DNA, 51 bp, Artificial Sequence; identical to SEQ ID NO: 4540
  Description of Artificial Sequence: Synthetic Light chain variable region CDR L1 nucleic acid sequence

SEQ ID NO: 6077 - protein, 7 aa, Artificial Sequence
  Description of Artificial Sequence: Synthetic Light chain variable region CDR L2 amino acid sequence
WASTRES

SEQ ID NO: 6078 - DNA, 21 bp, Artificial Sequence
  Description of Artificial Sequence: Synthetic Light chain variable region CDR L2 nucleic acid sequence
tgggcatctacccgggaatcc

SEQ ID NO: 6079 - protein, 8 aa, Artificial Sequence
  Description of Artificial Sequence: Synthetic Light chain variable region CDR L3 amino acid sequence
KQSYSRRT

SEQ ID NO: 6080 - DNA, 24 bp, Artificial Sequence
  Description of Artificial Sequence: Synthetic Light chain variable region CDR L3 nucleic acid sequence
aagcaatcttattctcggagaact

SEQ ID NO: 6081 - DNA, 357 bp, Artificial Sequence; identical to SEQ ID NO: 5281
  Description of Artificial Sequence: Synthetic Heavy chain variable region nucleic acid sequence

SEQ ID NO: 6082 - protein, 119 aa, Artificial Sequence; identical to SEQ ID NO: 5282
  Description of Artificial Sequence: Synthetic Heavy chain variable region amino acid sequence

SEQ ID NO: 6083 - protein, 9 aa, Artificial Sequence
  Description of Artificial Sequence: Synthetic Heavy chain variable region CDR H1 amino acid sequence
FNIKDYYMH

SEQ ID NO: 6084 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6085 - protein, 17 aa, Artificial Sequence
  Description of Artificial Sequence: Synthetic Heavy chain variable region CDR H2 amino acid sequence
WIDLENANTIYDAKFQG

SEQ ID NO: 6086 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6087 - protein, 12 aa, Artificial Sequence
  Description of Artificial Sequence: Synthetic Heavy chain variable region CDR H3 amino acid sequence
ARDQYGRYFYDV

SEQ ID NO: 6088 - DNA, 36 bp, Artificial Sequence; identical to SEQ ID NO: 5288
  Description of Artificial Sequence: Synthetic Heavy chain variable region CDR H3 nucleic acid sequence

SEQ ID NO: 6089 - DNA, 336 bp, Artificial Sequence; identical to SEQ ID NO: 4537
  Description of Artificial Sequence: Synthetic Light chain variable region nucleic acid sequence

SEQ ID NO: 6090 - protein, 112 aa, Artificial Sequence; identical to SEQ ID NO: 4538
  Description of Artificial Sequence: Synthetic Light chain variable region amino acid sequence

SEQ ID NO: 6091 - protein, 17 aa, Artificial Sequence
  Description of Artificial Sequence: Synthetic Light chain variable region CDR L1 amino acid sequence
KSSQSLLNARTGKNYLA

SEQ ID NO: 6092 - DNA, 51 bp, Artificial Sequence; identical to SEQ ID NO: 4540
  Description of Artificial Sequence: Synthetic Light chain variable region CDR L1 nucleic acid sequence

SEQ ID NO: 6093 - protein, 7 aa, Artificial Sequence
  Description of Artificial Sequence: Synthetic Light chain variable region CDR L2 amino acid sequence
WASTRES

SEQ ID NO: 6094 - DNA, 21 bp, Artificial Sequence
  Description of Artificial Sequence: Synthetic Light chain variable region CDR L2 nucleic acid sequence
tgggcatctacccgggaatcc

SEQ ID NO: 6095 - protein, 8 aa, Artificial Sequence
  Description of Artificial Sequence: Synthetic Light chain variable region CDR L3 amino acid sequence
KQSYSRRT

SEQ ID NO: 6096 - DNA, 24 bp, Artificial Sequence
  Description of Artificial Sequence: Synthetic Light chain variable region CDR L3 nucleic acid sequence
aagcaatcttattctcggagaact

SEQ ID NO: 6097 - DNA, 357 bp, Artificial Sequence; identical to SEQ ID NO: 5313
  Description of Artificial Sequence: Synthetic Heavy chain variable region nucleic acid sequence

SEQ ID NO: 6098 - protein, 119 aa, Artificial Sequence; identical to SEQ ID NO: 5314
  Description of Artificial Sequence: Synthetic Heavy chain variable region amino acid sequence

SEQ ID NO: 6099 - protein, 9 aa, Artificial Sequence
  Description of Artificial Sequence: Synthetic Heavy chain variable region CDR H1 amino acid sequence
FNIKDYYMH

SEQ ID NO: 6100 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6101 - protein, 17 aa, Artificial Sequence
  Description of Artificial Sequence: Synthetic Heavy chain variable region CDR H2 amino acid sequence
WIDLENANTIYDAKFQG

SEQ ID NO: 6102 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6103 - protein, 12 aa, Artificial Sequence
  Description of Artificial Sequence: Synthetic Heavy chain variable region CDR H3 amino acid sequence
ARDVYGRYFYDL

SEQ ID NO: 6104 - DNA, 36 bp, Artificial Sequence; identical to SEQ ID NO: 5320
  Description of Artificial Sequence: Synthetic Heavy chain variable region CDR H3 nucleic acid sequence

SEQ ID NO: 6105 - DNA, 336 bp, Artificial Sequence; identical to SEQ ID NO: 4537
  Description of Artificial Sequence: Synthetic Light chain variable region nucleic acid sequence

SEQ ID NO: 6106 - protein, 112 aa, Artificial Sequence; identical to SEQ ID NO: 4538
  Description of Artificial Sequence: Synthetic Light chain variable region amino acid sequence

SEQ ID NO: 6107 - protein, 17 aa, Artificial Sequence
  Description of Artificial Sequence: Synthetic Light chain variable region CDR L1 amino acid sequence
KSSQSLLNARTGKNYLA

SEQ ID NO: 6108 - DNA, 51 bp, Artificial Sequence; identical to SEQ ID NO: 4540
  Description of Artificial Sequence: Synthetic Light chain variable region CDR L1 nucleic acid sequence

SEQ ID NO: 6109 - protein, 7 aa, Artificial Sequence
  Description of Artificial Sequence: Synthetic Light chain variable region CDR L2 amino acid sequence
WASTRES

SEQ ID NO: 6110 - DNA, 21 bp, Artificial Sequence
  Description of Artificial Sequence: Synthetic Light chain variable region CDR L2 nucleic acid sequence
tgggcatctacccgggaatcc

SEQ ID NO: 6111 - protein, 8 aa, Artificial Sequence
  Description of Artificial Sequence: Synthetic Light chain variable region CDR L3 amino acid sequence
KQSYSRRT

SEQ ID NO: 6112 - DNA, 24 bp, Artificial Sequence
  Description of Artificial Sequence: Synthetic Light chain variable region CDR L3 nucleic acid sequence
aagcaatcttattctcggagaact

SEQ ID NO: 6113 - DNA, 357 bp, Artificial Sequence; identical to SEQ ID NO: 5329
  Description of Artificial Sequence: Synthetic Heavy chain variable region nucleic acid sequence

SEQ ID NO: 6114 - protein, 119 aa, Artificial Sequence; identical to SEQ ID NO: 5330
  Description of Artificial Sequence: Synthetic Heavy chain variable region amino acid sequence

SEQ ID NO: 6115 - protein, 9 aa, Artificial Sequence
  Description of Artificial Sequence: Synthetic Heavy chain variable region CDR H1 amino acid sequence
FNIKDYYMH

SEQ ID NO: 6116 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6117 - protein, 17 aa, Artificial Sequence
  Description of Artificial Sequence: Synthetic Heavy chain variable region CDR H2 amino acid sequence
WIDLENANTIYDAKFQG

SEQ ID NO: 6118 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6119 - protein, 12 aa, Artificial Sequence
  Description of Artificial Sequence: Synthetic Heavy chain variable region CDR H3 amino acid sequence
ARDAYGGYFYDV

SEQ ID NO: 6120 - DNA, 36 bp, Artificial Sequence; identical to SEQ ID NO: 5336
  Description of Artificial Sequence: Synthetic Heavy chain variable region CDR H3 nucleic acid sequence

SEQ ID NO: 6121 - DNA, 336 bp, Artificial Sequence; identical to SEQ ID NO: 4537
  Description of Artificial Sequence: Synthetic Light chain variable region nucleic acid sequence

SEQ ID NO: 6122 - protein, 112 aa, Artificial Sequence; identical to SEQ ID NO: 4538
  Description of Artificial Sequence: Synthetic Light chain variable region amino acid sequence

SEQ ID NO: 6123 - protein, 17 aa, Artificial Sequence
  Description of Artificial Sequence: Synthetic Light chain variable region CDR L1 amino acid sequence
KSSQSLLNARTGKNYLA

SEQ ID NO: 6124 - DNA, 51 bp, Artificial Sequence; identical to SEQ ID NO: 4540
  Description of Artificial Sequence: Synthetic Light chain variable region CDR L1 nucleic acid sequence

SEQ ID NO: 6125 - protein, 7 aa, Artificial Sequence
  Description of Artificial Sequence: Synthetic Light chain variable region CDR L2 amino acid sequence
WASTRES

SEQ ID NO: 6126 - DNA, 21 bp, Artificial Sequence
  Description of Artificial Sequence: Synthetic Light chain variable region CDR L2 nucleic acid sequence
tgggcatctacccgggaatcc

SEQ ID NO: 6127 - protein, 8 aa, Artificial Sequence
  Description of Artificial Sequence: Synthetic Light chain variable region CDR L3 amino acid sequence
KQSYSRRT

SEQ ID NO: 6128 - DNA, 24 bp, Artificial Sequence
  Description of Artificial Sequence: Synthetic Light chain variable region CDR L3 nucleic acid sequence
aagcaatcttattctcggagaact

SEQ ID NO: 6129 - DNA, 357 bp, Artificial Sequence; identical to SEQ ID NO: 5345
  Description of Artificial Sequence: Synthetic Heavy chain variable region nucleic acid sequence

SEQ ID NO: 6130 - protein, 119 aa, Artificial Sequence; identical to SEQ ID NO: 5346
  Description of Artificial Sequence: Synthetic Heavy chain variable region amino acid sequence

SEQ ID NO: 6131 - protein, 9 aa, Artificial Sequence
  Description of Artificial Sequence: Synthetic Heavy chain variable region CDR H1 amino acid sequence
FNIKDYYMH

SEQ ID NO: 6132 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6133 - protein, 17 aa, Artificial Sequence
  Description of Artificial Sequence: Synthetic Heavy chain variable region CDR H2 amino acid sequence
WIDLENANTIYDAKFQG

SEQ ID NO: 6134 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6135 - protein, 12 aa, Artificial Sequence
  Description of Artificial Sequence: Synthetic Heavy chain variable region CDR H3 amino acid sequence
ARDNYGGYFYDV

SEQ ID NO: 6136 - DNA, 36 bp, Artificial Sequence; identical to SEQ ID NO: 5352
  Description of Artificial Sequence: Synthetic Heavy chain variable region CDR H3 nucleic acid sequence

SEQ ID NO: 6137 - DNA, 336 bp, Artificial Sequence; identical to SEQ ID NO: 4537
  Description of Artificial Sequence: Synthetic Light chain variable region nucleic acid sequence

SEQ ID NO: 6138 - protein, 112 aa, Artificial Sequence; identical to SEQ ID NO: 4538
  Description of Artificial Sequence: Synthetic Light chain variable region amino acid sequence

SEQ ID NO: 6139 - protein, 17 aa, Artificial Sequence
  Description of Artificial Sequence: Synthetic Light chain variable region CDR L1 amino acid sequence
KSSQSLLNARTGKNYLA

SEQ ID NO: 6140 - DNA, 51 bp, Artificial Sequence; identical to SEQ ID NO: 4540
  Description of Artificial Sequence: Synthetic Light chain variable region CDR L1 nucleic acid sequence

SEQ ID NO: 6141 - protein, 7 aa, Artificial Sequence
  Description of Artificial Sequence: Synthetic Light chain variable region CDR L2 amino acid sequence
WASTRES

SEQ ID NO: 6142 - DNA, 21 bp, Artificial Sequence
  Description of Artificial Sequence: Synthetic Light chain variable region CDR L2 nucleic acid sequence
tgggcatctacccgggaatcc

SEQ ID NO: 6143 - protein, 8 aa, Artificial Sequence
  Description of Artificial Sequence: Synthetic Light chain variable region CDR L3 amino acid sequence
KQSYSRRT

SEQ ID NO: 6144 - DNA, 24 bp, Artificial Sequence
  Description of Artificial Sequence: Synthetic Light chain variable region CDR L3 nucleic acid sequence
aagcaatcttattctcggagaact

SEQ ID NO: 6145 - DNA, 375 bp, Artificial Sequence; identical to SEQ ID NO: 1
  Description of Artificial Sequence: Synthetic Heavy chain variable region nucleic acid sequence

SEQ ID NO: 6146 - protein, 125 aa, Artificial Sequence; identical to SEQ ID NO: 2
  Description of Artificial Sequence: Synthetic Heavy chain variable region amino acid sequence

SEQ ID NO: 6147 - protein, 9 aa, Artificial Sequence
  Description of Artificial Sequence: Synthetic Heavy chain variable region CDR H1 amino acid sequence
FTFNTYAMN

SEQ ID NO: 6148 - DNA, 27 bp, Artificial Sequence
  Description of Artificial Sequence: Synthetic Heavy chain variable region CDR H1 nucleic acid sequence
ttcacctttaacacatatgccatgaat

SEQ ID NO: 6149 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6150 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6151 - protein, 16 aa, Artificial Sequence
  Description of Artificial Sequence: Synthetic Heavy chain variable region CDR H3 amino acid sequence
VRHGNFGNSYVSWFAY

SEQ ID NO: 6152 - DNA, 48 bp, Artificial Sequence; identical to SEQ ID NO: 8
  Description of Artificial Sequence: Synthetic Heavy chain variable region CDR H3 nucleic acid sequence

SEQ ID NO: 6153 - DNA, 327 bp, Artificial Sequence; identical to SEQ ID NO: 25
  Description of Artificial Sequence: Synthetic Light chain variable region nucleic acid sequence

SEQ ID NO: 6154 - protein, 109 aa, Artificial Sequence; identical to SEQ ID NO: 26
  Description of Artificial Sequence: Synthetic Light chain variable region amino acid sequence

SEQ ID NO: 6155 - protein, 14 aa, Artificial Sequence
  Description of Artificial Sequence: Synthetic Light chain variable region CDR L1 amino acid sequence
RSSTGAVTTSNYAN

SEQ ID NO: 6156 - DNA, 42 bp, Artificial Sequence; identical to SEQ ID NO: 12
  Description of Artificial Sequence: Synthetic Light chain variable region CDR L1 nucleic acid sequence

SEQ ID NO: 6157 - protein, 7 aa, Artificial Sequence
  Description of Artificial Sequence: Synthetic Light chain variable region CDR L2 amino acid sequence
GTDKRAP

SEQ ID NO: 6158 - DNA, 21 bp, Artificial Sequence
  Description of Artificial Sequence: Synthetic Light chain variable region CDR L2 nucleic acid sequence
ggcacagacaagcgcgctccc

SEQ ID NO: 6159 - protein, 9 aa, Artificial Sequence
  Description of Artificial Sequence: Synthetic Light chain variable region CDR L3 amino acid sequence
ALWYSNLWV

SEQ ID NO: 6160 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 6161 - DNA, 375 bp, Artificial Sequence; identical to SEQ ID NO: 1
  Description of Artificial Sequence: Synthetic Heavy chain variable region nucleic acid sequence

SEQ ID NO: 6162 - protein, 125 aa, Artificial Sequence; identical to SEQ ID NO: 2
  Description of Artificial Sequence: Synthetic Heavy chain variable region amino acid sequence

SEQ ID NO: 6163 - protein, 9 aa, Artificial Sequence
  Description of Artificial Sequence: Synthetic Heavy chain variable region CDR H1 amino acid sequence
FTFNTYAMN

SEQ ID NO: 6164 - DNA, 27 bp, Artificial Sequence
  Description of Artificial Sequence: Synthetic Heavy chain variable region CDR H1 nucleic acid sequence
ttcacctttaacacatatgccatgaat

SEQ ID NO: 6165 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6166 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6167 - protein, 16 aa, Artificial Sequence
  Description of Artificial Sequence: Synthetic Heavy chain variable region CDR H3 amino acid sequence
VRHGNFGNSYVSWFAY

SEQ ID NO: 6168 - DNA, 48 bp, Artificial Sequence; identical to SEQ ID NO: 8
  Description of Artificial Sequence: Synthetic Heavy chain variable region CDR H3 nucleic acid sequence

SEQ ID NO: 6169 - DNA, 327 bp, Artificial Sequence; identical to SEQ ID NO: 41
  Description of Artificial Sequence: Synthetic Light chain variable region nucleic acid sequence

SEQ ID NO: 6170 - protein, 109 aa, Artificial Sequence; identical to SEQ ID NO: 42
  Description of Artificial Sequence: Synthetic Light chain variable region amino acid sequence

SEQ ID NO: 6171 - protein, 14 aa, Artificial Sequence
  Description of Artificial Sequence: Synthetic Light chain variable region CDR L1 amino acid sequence
RSSTGAVTTSNYAN

SEQ ID NO: 6172 - DNA, 42 bp, Artificial Sequence; identical to SEQ ID NO: 12
  Description of Artificial Sequence: Synthetic Light chain variable region CDR L1 nucleic acid sequence

SEQ ID NO: 6173 - protein, 7 aa, Artificial Sequence
  Description of Artificial Sequence: Synthetic Light chain variable region CDR L2 amino acid sequence
GTNKRAP

SEQ ID NO: 6174 - DNA, 21 bp, Artificial Sequence
  Description of Artificial Sequence: Synthetic Light chain variable region CDR L2 nucleic acid sequence
ggcacaaacaagcgcgctcct

SEQ ID NO: 6175 - protein, 9 aa, Artificial Sequence
  Description of Artificial Sequence: Synthetic Light chain variable region CDR L3 amino acid sequence
ALWYSNLWV

SEQ ID NO: 6176 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 6177 - DNA, 375 bp, Artificial Sequence; identical to SEQ ID NO: 81
  Description of Artificial Sequence: Synthetic Heavy chain variable region nucleic acid sequence

SEQ ID NO: 6178 - protein, 125 aa, Artificial Sequence; identical to SEQ ID NO: 82
  Description of Artificial Sequence: Synthetic Heavy chain variable region amino acid sequence

SEQ ID NO: 6179 - protein, 9 aa, Artificial Sequence
  Description of Artificial Sequence: Synthetic Heavy chain variable region CDR H1 amino acid sequence
FTFDTYAMN

SEQ ID NO: 6180 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 6181 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6182 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6183 - protein, 16 aa, Artificial Sequence
  Description of Artificial Sequence: Synthetic Heavy chain variable region CDR H3 amino acid sequence
VRHGNFGNSYVSWFAH

SEQ ID NO: 6184 - DNA, 48 bp, Artificial Sequence; identical to SEQ ID NO: 72
  Description of Artificial Sequence: Synthetic Heavy chain variable region CDR H3 nucleic acid sequence

SEQ ID NO: 6185 - DNA, 327 bp, Artificial Sequence
  Description of Artificial Sequence: Synthetic Light chain variable region nucleic acid sequence
cagactgtggtgacccaggagccatcgttctcagtgtcccctggagggacagtcacactcacttgtagatcaagcactggcgcagtcactactagtaactacgccaactgggtccagcagaccccaggccaggctccgcgcggactcatcggcggcacaaacaagcgcgctcctggggtccctgatcgcttctctggctccctgcttggggacaaagctgccctcaccatcacgggggcccaggcagatgatgaatctgattattactgtgcgctgtggtacagtaacctttgggtgttcggcggagggaccaagctgaccgtccta

SEQ ID NO: 6186 - protein, 109 aa, Artificial Sequence; identical to SEQ ID NO: 10
  Description of Artificial Sequence: Synthetic Light chain variable region amino acid sequence

SEQ ID NO: 6187 - protein, 14 aa, Artificial Sequence
  Description of Artificial Sequence: Synthetic Light chain variable region CDR L1 amino acid sequence
RSSTGAVTTSNYAN

SEQ ID NO: 6188 - DNA, 42 bp, Artificial Sequence; identical to SEQ ID NO: 12
  Description of Artificial Sequence: Synthetic Light chain variable region CDR L1 nucleic acid sequence

SEQ ID NO: 6189 - protein, 7 aa, Artificial Sequence
  Description of Artificial Sequence: Synthetic Light chain variable region CDR L2 amino acid sequence
GTNKRAP

SEQ ID NO: 6190 - DNA, 21 bp, Artificial Sequence
  Description of Artificial Sequence: Synthetic Light chain variable region CDR L2 nucleic acid sequence
ggcacaaacaagcgcgctcct

SEQ ID NO: 6191 - protein, 9 aa, Artificial Sequence
  Description of Artificial Sequence: Synthetic Light chain variable region CDR L3 amino acid sequence
ALWYSNLWV

SEQ ID NO: 6192 - DNA, 27 bp, Artificial Sequence
  Description of Artificial Sequence: Synthetic Light chain variable region CDR L3 nucleic acid sequence
gcgctgtggtacagtaacctttgggtg

SEQ ID NO: 6193 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatgcgtacgggagatatttttacagggtgtggggccaaggaaccctggtcaccgtctcctca

SEQ ID NO: 6194 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDAYGRYFYRVWGQGTLVTVSS

SEQ ID NO: 6195 - protein, 9 aa, Artificial Sequence
  Description of Artificial Sequence: Synthetic Heavy chain variable region CDR H1 amino acid sequence
FNIKDYYMH

SEQ ID NO: 6196 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6197 - protein, 17 aa, Artificial Sequence
  Description of Artificial Sequence: Synthetic Heavy chain variable region CDR H2 amino acid sequence
WIDLENANTIYDAKFQG

SEQ ID NO: 6198 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6199 - protein, 12 aa, Artificial Sequence
  Description of Artificial Sequence: Synthetic Heavy chain variable region CDR H3 amino acid sequence
ARDAYGRYFYRV

SEQ ID NO: 6200 - DNA, 36 bp, Artificial Sequence
  Description of Artificial Sequence: Synthetic Heavy chain variable region CDR H3 nucleic acid sequence
gcgagagatgcgtacgggagatatttttacagggtg

SEQ ID NO: 6201 - DNA, 336 bp, Artificial Sequence; identical to SEQ ID NO: 4537
  Description of Artificial Sequence: Synthetic Light chain variable region nucleic acid sequence

SEQ ID NO: 6202 - protein, 112 aa, Artificial Sequence; identical to SEQ ID NO: 4538
  Description of Artificial Sequence: Synthetic Light chain variable region amino acid sequence

SEQ ID NO: 6203 - protein, 17 aa, Artificial Sequence
  Description of Artificial Sequence: Synthetic Light chain variable region CDR L1 amino acid sequence
KSSQSLLNARTGKNYLA

SEQ ID NO: 6204 - DNA, 51 bp, Artificial Sequence; identical to SEQ ID NO: 4540
  Description of Artificial Sequence: Synthetic Light chain variable region CDR L1 nucleic acid sequence

SEQ ID NO: 6205 - protein, 7 aa, Artificial Sequence
  Description of Artificial Sequence: Synthetic Light chain variable region CDR L2 amino acid sequence
WASTRES

SEQ ID NO: 6206 - DNA, 21 bp, Artificial Sequence
  Description of Artificial Sequence: Synthetic Light chain variable region CDR L2 nucleic acid sequence
tgggcatctacccgggaatcc

SEQ ID NO: 6207 - protein, 8 aa, Artificial Sequence
  Description of Artificial Sequence: Synthetic Light chain variable region CDR L3 amino acid sequence
KQSYSRRT

SEQ ID NO: 6208 - DNA, 24 bp, Artificial Sequence
  Description of Artificial Sequence: Synthetic Light chain variable region CDR L3 nucleic acid sequence
aagcaatcttattctcggagaact

SEQ ID NO: 6209 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcccgagagatgcttacgggagatatttttacgacgtgtggggccaaggaaccctggtcaccgtctcctca

SEQ ID NO: 6210 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCPRDAYGRYFYDVWGQGTLVTVSS

SEQ ID NO: 6211 - protein, 9 aa, Artificial Sequence
  Description of Artificial Sequence: Synthetic Heavy chain variable region CDR H1 amino acid sequence
FNIKDYYMH

SEQ ID NO: 6212 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6213 - protein, 17 aa, Artificial Sequence
  Description of Artificial Sequence: Synthetic Heavy chain variable region CDR H2 amino acid sequence
WIDLENANTIYDAKFQG

SEQ ID NO: 6214 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6215 - protein, 12 aa, Artificial Sequence
  Description of Artificial Sequence: Synthetic Heavy chain variable region CDR H3 amino acid sequence
PRDAYGRYFYDV

SEQ ID NO: 6216 - DNA, 36 bp, Artificial Sequence
  Description of Artificial Sequence: Synthetic Heavy chain variable region CDR H3 nucleic acid sequence
ccgagagatgcttacgggagatatttttacgacgtg

SEQ ID NO: 6217 - DNA, 336 bp, Artificial Sequence; identical to SEQ ID NO: 4537
  Description of Artificial Sequence: Synthetic Light chain variable region nucleic acid sequence

SEQ ID NO: 6218 - protein, 112 aa, Artificial Sequence; identical to SEQ ID NO: 4538
  Description of Artificial Sequence: Synthetic Light chain variable region amino acid sequence

SEQ ID NO: 6219 - protein, 17 aa, Artificial Sequence
  Description of Artificial Sequence: Synthetic Light chain variable region CDR L1 amino acid sequence
KSSQSLLNARTGKNYLA

SEQ ID NO: 6220 - DNA, 51 bp, Artificial Sequence; identical to SEQ ID NO: 4540
  Description of Artificial Sequence: Synthetic Light chain variable region CDR L1 nucleic acid sequence

SEQ ID NO: 6221 - protein, 7 aa, Artificial Sequence
  Description of Artificial Sequence: Synthetic Light chain variable region CDR L2 amino acid sequence
WASTRES

SEQ ID NO: 6222 - DNA, 21 bp, Artificial Sequence
  Description of Artificial Sequence: Synthetic Light chain variable region CDR L2 nucleic acid sequence
tgggcatctacccgggaatcc

SEQ ID NO: 6223 - protein, 8 aa, Artificial Sequence
  Description of Artificial Sequence: Synthetic Light chain variable region CDR L3 amino acid sequence
KQSYSRRT

SEQ ID NO: 6224 - DNA, 24 bp, Artificial Sequence
  Description of Artificial Sequence: Synthetic Light chain variable region CDR L3 nucleic acid sequence
aagcaatcttattctcggagaact

SEQ ID NO: 6225 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatgcgtacgggagatatttttacgacgggtggggccaaggaaccctggtcaccgtctcctca

SEQ ID NO: 6226 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDAYGRYFYDGWGQGTLVTVSS

SEQ ID NO: 6227 - protein, 9 aa, Artificial Sequence
  Description of Artificial Sequence: Synthetic Heavy chain variable region CDR H1 amino acid sequence
FNIKDYYMH

SEQ ID NO: 6228 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6229 - protein, 17 aa, Artificial Sequence
  Description of Artificial Sequence: Synthetic Heavy chain variable region CDR H2 amino acid sequence
WIDLENANTIYDAKFQG

SEQ ID NO: 6230 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6231 - protein, 12 aa, Artificial Sequence
  Description of Artificial Sequence: Synthetic Heavy chain variable region CDR H3 amino acid sequence
ARDAYGRYFYDG

SEQ ID NO: 6232 - DNA, 36 bp, Artificial Sequence
  Description of Artificial Sequence: Synthetic Heavy chain variable region CDR H3 nucleic acid sequence
gcgagagatgcgtacgggagatatttttacgacggg

SEQ ID NO: 6233 - DNA, 336 bp, Artificial Sequence; identical to SEQ ID NO: 4537
  Description of Artificial Sequence: Synthetic Light chain variable region nucleic acid sequence

SEQ ID NO: 6234 - protein, 112 aa, Artificial Sequence; identical to SEQ ID NO: 4538
  Description of Artificial Sequence: Synthetic Light chain variable region amino acid sequence

SEQ ID NO: 6235 - protein, 17 aa, Artificial Sequence
  Description of Artificial Sequence: Synthetic Light chain variable region CDR L1 amino acid sequence
KSSQSLLNARTGKNYLA

SEQ ID NO: 6236 - DNA, 51 bp, Artificial Sequence; identical to SEQ ID NO: 4540
  Description of Artificial Sequence: Synthetic Light chain variable region CDR L1 nucleic acid sequence

SEQ ID NO: 6237 - protein, 7 aa, Artificial Sequence
  Description of Artificial Sequence: Synthetic Light chain variable region CDR L2 amino acid sequence
WASTRES

SEQ ID NO: 6238 - DNA, 21 bp, Artificial Sequence
  Description of Artificial Sequence: Synthetic Light chain variable region CDR L2 nucleic acid sequence
tgggcatctacccgggaatcc

SEQ ID NO: 6239 - protein, 8 aa, Artificial Sequence
  Description of Artificial Sequence: Synthetic Light chain variable region CDR L3 amino acid sequence
KQSYSRRT

SEQ ID NO: 6240 - DNA, 24 bp, Artificial Sequence
  Description of Artificial Sequence: Synthetic Light chain variable region CDR L3 nucleic acid sequence
aagcaatcttattctcggagaact

SEQ ID NO: 6241 - DNA, 357 bp, Artificial Sequence; identical to SEQ ID NO: 5249
  Description of Artificial Sequence: Synthetic Heavy chain variable region nucleic acid sequence

SEQ ID NO: 6242 - protein, 119 aa, Artificial Sequence; identical to SEQ ID NO: 5250
  Description of Artificial Sequence: Synthetic Heavy chain variable region amino acid sequence

SEQ ID NO: 6243 - protein, 9 aa, Artificial Sequence
  Description of Artificial Sequence: Synthetic Heavy chain variable region CDR H1 amino acid sequence
FNIKDYYMH

SEQ ID NO: 6244 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6245 - protein, 17 aa, Artificial Sequence
  Description of Artificial Sequence: Synthetic Heavy chain variable region CDR H2 amino acid sequence
WIDLENANTIYDAKFQG

SEQ ID NO: 6246 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6247 - protein, 12 aa, Artificial Sequence
  Description of Artificial Sequence: Synthetic Heavy chain variable region CDR H3 amino acid sequence
ARDRYGAYFYDV

SEQ ID NO: 6248 - DNA, 36 bp, Artificial Sequence; identical to SEQ ID NO: 5256
  Description of Artificial Sequence: Synthetic Heavy chain variable region CDR H3 nucleic acid sequence

SEQ ID NO: 6249 - DNA, 336 bp, Artificial Sequence; identical to SEQ ID NO: 4537
  Description of Artificial Sequence: Synthetic Light chain variable region nucleic acid sequence

SEQ ID NO: 6250 - protein, 112 aa, Artificial Sequence; identical to SEQ ID NO: 4538
  Description of Artificial Sequence: Synthetic Light chain variable region amino acid sequence

SEQ ID NO: 6251 - protein, 17 aa, Artificial Sequence
  Description of Artificial Sequence: Synthetic Light chain variable region CDR L1 amino acid sequence
KSSQSLLNARTGKNYLA

SEQ ID NO: 6252 - DNA, 51 bp, Artificial Sequence; identical to SEQ ID NO: 4540
  Description of Artificial Sequence: Synthetic Light chain variable region CDR L1 nucleic acid sequence

SEQ ID NO: 6253 - protein, 7 aa, Artificial Sequence
  Description of Artificial Sequence: Synthetic Light chain variable region CDR L2 amino acid sequence
WASTRES

SEQ ID NO: 6254 - DNA, 21 bp, Artificial Sequence
  Description of Artificial Sequence: Synthetic Light chain variable region CDR L2 nucleic acid sequence
tgggcatctacccgggaatcc

SEQ ID NO: 6255 - protein, 8 aa, Artificial Sequence
  Description of Artificial Sequence: Synthetic Light chain variable region CDR L3 amino acid sequence
KQSYSRRT

SEQ ID NO: 6256 - DNA, 24 bp, Artificial Sequence
  Description of Artificial Sequence: Synthetic Light chain variable region CDR L3 nucleic acid sequence
aagcaatcttattctcggagaact

SEQ ID NO: 6257 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatcggtacgggagatatttttacgacgtgtggggccaaggaaccctggtcaccgtctcctca

SEQ ID NO: 6258 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDRYGRYFYDVWGQGTLVTVSS

SEQ ID NO: 6259 - protein, 9 aa, Artificial Sequence
  Description of Artificial Sequence: Synthetic Heavy chain variable region CDR H1 amino acid sequence
FNIKDYYMH

SEQ ID NO: 6260 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6261 - protein, 17 aa, Artificial Sequence
  Description of Artificial Sequence: Synthetic Heavy chain variable region CDR H2 amino acid sequence
WIDLENANTIYDAKFQG

SEQ ID NO: 6262 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6263 - protein, 12 aa, Artificial Sequence
  Description of Artificial Sequence: Synthetic Heavy chain variable region CDR H3 amino acid sequence
ARDRYGRYFYDV

SEQ ID NO: 6264 - DNA, 36 bp, Artificial Sequence
  Description of Artificial Sequence: Synthetic Heavy chain variable region CDR H3 nucleic acid sequence
gcgagagatcggtacgggagatatttttacgacgtg

SEQ ID NO: 6265 - DNA, 336 bp, Artificial Sequence; identical to SEQ ID NO: 4537
  Description of Artificial Sequence: Synthetic Light chain variable region nucleic acid sequence

SEQ ID NO: 6266 - protein, 112 aa, Artificial Sequence; identical to SEQ ID NO: 4538
  Description of Artificial Sequence: Synthetic Light chain variable region amino acid sequence

SEQ ID NO: 6267 - protein, 17 aa, Artificial Sequence
  Description of Artificial Sequence: Synthetic Light chain variable region CDR L1 amino acid sequence
KSSQSLLNARTGKNYLA

SEQ ID NO: 6268 - DNA, 51 bp, Artificial Sequence; identical to SEQ ID NO: 4540
  Description of Artificial Sequence: Synthetic Light chain variable region CDR L1 nucleic acid sequence

SEQ ID NO: 6269 - protein, 7 aa, Artificial Sequence
  Description of Artificial Sequence: Synthetic Light chain variable region CDR L2 amino acid sequence
WASTRES

SEQ ID NO: 6270 - DNA, 21 bp, Artificial Sequence
  Description of Artificial Sequence: Synthetic Light chain variable region CDR L2 nucleic acid sequence
tgggcatctacccgggaatcc

SEQ ID NO: 6271 - protein, 8 aa, Artificial Sequence
  Description of Artificial Sequence: Synthetic Light chain variable region CDR L3 amino acid sequence
KQSYSRRT

SEQ ID NO: 6272 - DNA, 24 bp, Artificial Sequence
  Description of Artificial Sequence: Synthetic Light chain variable region CDR L3 nucleic acid sequence
aagcaatcttattctcggagaact

SEQ ID NO: 6273 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagattcgtacgggagatatttttacgacgtgtggggccaaggaaccctggtcaccgtctcctca

SEQ ID NO: 6274 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDSYGRYFYDVWGQGTLVTVSS

SEQ ID NO: 6275 - protein, 9 aa, Artificial Sequence
  Description of Artificial Sequence: Synthetic Heavy chain variable region CDR H1 amino acid sequence
FNIKDYYMH

SEQ ID NO: 6276 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6277 - protein, 17 aa, Artificial Sequence
  Description of Artificial Sequence: Synthetic Heavy chain variable region CDR H2 amino acid sequence
WIDLENANTIYDAKFQG

SEQ ID NO: 6278 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6279 - protein, 12 aa, Artificial Sequence
  Description of Artificial Sequence: Synthetic Heavy chain variable region CDR H3 amino acid sequence
ARDSYGRYFYDV

SEQ ID NO: 6280 - DNA, 36 bp, Artificial Sequence
  Description of Artificial Sequence: Synthetic Heavy chain variable region CDR H3 nucleic acid sequence
gcgagagattcgtacgggagatatttttacgacgtg

SEQ ID NO: 6281 - DNA, 336 bp, Artificial Sequence; identical to SEQ ID NO: 4537
  Description of Artificial Sequence: Synthetic Light chain variable region nucleic acid sequence

SEQ ID NO: 6282 - protein, 112 aa, Artificial Sequence; identical to SEQ ID NO: 4538
  Description of Artificial Sequence: Synthetic Light chain variable region amino acid sequence

SEQ ID NO: 6283 - protein, 17 aa, Artificial Sequence
  Description of Artificial Sequence: Synthetic Light chain variable region CDR L1 amino acid sequence
KSSQSLLNARTGKNYLA

SEQ ID NO: 6284 - DNA, 51 bp, Artificial Sequence; identical to SEQ ID NO: 4540
  Description of Artificial Sequence: Synthetic Light chain variable region CDR L1 nucleic acid sequence

SEQ ID NO: 6285 - protein, 7 aa, Artificial Sequence
  Description of Artificial Sequence: Synthetic Light chain variable region CDR L2 amino acid sequence
WASTRES

SEQ ID NO: 6286 - DNA, 21 bp, Artificial Sequence
  Description of Artificial Sequence: Synthetic Light chain variable region CDR L2 nucleic acid sequence
tgggcatctacccgggaatcc

SEQ ID NO: 6287 - protein, 8 aa, Artificial Sequence
  Description of Artificial Sequence: Synthetic Light chain variable region CDR L3 amino acid sequence
KQSYSRRT

SEQ ID NO: 6288 - DNA, 24 bp, Artificial Sequence
  Description of Artificial Sequence: Synthetic Light chain variable region CDR L3 nucleic acid sequence
aagcaatcttattctcggagaact

SEQ ID NO: 6289 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatgtgtacgggagatatctttacgacgtgtggggccaaggaaccctggtcaccgtctcctca

SEQ ID NO: 6290 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDVYGRYLYDVWGQGTLVTVSS

SEQ ID NO: 6291 - protein, 9 aa, Artificial Sequence
  Description of Artificial Sequence: Synthetic Heavy chain variable region CDR H1 amino acid sequence
FNIKDYYMH

SEQ ID NO: 6292 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6293 - protein, 17 aa, Artificial Sequence
  Description of Artificial Sequence: Synthetic Heavy chain variable region CDR H2 amino acid sequence
WIDLENANTIYDAKFQG

SEQ ID NO: 6294 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6295 - protein, 12 aa, Artificial Sequence
  Description of Artificial Sequence: Synthetic Heavy chain variable region CDR H3 amino acid sequence
ARDVYGRYLYDV

SEQ ID NO: 6296 - DNA, 36 bp, Artificial Sequence
  Description of Artificial Sequence: Synthetic Heavy chain variable region CDR H3 nucleic acid sequence
gcgagagatgtgtacgggagatatctttacgacgtg

SEQ ID NO: 6297 - DNA, 336 bp, Artificial Sequence; identical to SEQ ID NO: 4537
  Description of Artificial Sequence: Synthetic Light chain variable region nucleic acid sequence

SEQ ID NO: 6298 - protein, 112 aa, Artificial Sequence; identical to SEQ ID NO: 4538
  Description of Artificial Sequence: Synthetic Light chain variable region amino acid sequence

SEQ ID NO: 6299 - protein, 17 aa, Artificial Sequence
  Description of Artificial Sequence: Synthetic Light chain variable region CDR L1 amino acid sequence
KSSQSLLNARTGKNYLA

SEQ ID NO: 6300 - DNA, 51 bp, Artificial Sequence; identical to SEQ ID NO: 4540
  Description of Artificial Sequence: Synthetic Light chain variable region CDR L1 nucleic acid sequence

SEQ ID NO: 6301 - protein, 7 aa, Artificial Sequence
  Description of Artificial Sequence: Synthetic Light chain variable region CDR L2 amino acid sequence
WASTRES

SEQ ID NO: 6302 - DNA, 21 bp, Artificial Sequence
  Description of Artificial Sequence: Synthetic Light chain variable region CDR L2 nucleic acid sequence
tgggcatctacccgggaatcc

SEQ ID NO: 6303 - protein, 8 aa, Artificial Sequence
  Description of Artificial Sequence: Synthetic Light chain variable region CDR L3 amino acid sequence
KQSYSRRT

SEQ ID NO: 6304 - DNA, 24 bp, Artificial Sequence
  Description of Artificial Sequence: Synthetic Light chain variable region CDR L3 nucleic acid sequence
aagcaatcttattctcggagaact

SEQ ID NO: 6305 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgcgagagatgtgtacaggagatatttttacgacgtgtggggccaaggaaccctggtcaccgtctcctca

SEQ ID NO: 6306 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCARDVYRRYFYDVWGQGTLVTVSS

SEQ ID NO: 6307 - protein, 9 aa, Artificial Sequence
  Description of Artificial Sequence: Synthetic Heavy chain variable region CDR H1 amino acid sequence
FNIKDYYMH

SEQ ID NO: 6308 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6309 - protein, 17 aa, Artificial Sequence
  Description of Artificial Sequence: Synthetic Heavy chain variable region CDR H2 amino acid sequence
WIDLENANTIYDAKFQG

SEQ ID NO: 6310 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6311 - protein, 12 aa, Artificial Sequence
  Description of Artificial Sequence: Synthetic Heavy chain variable region CDR H3 amino acid sequence
ARDVYRRYFYDV

SEQ ID NO: 6312 - DNA, 36 bp, Artificial Sequence
  Description of Artificial Sequence: Synthetic Heavy chain variable region CDR H3 nucleic acid sequence
gcgagagatgtgtacaggagatatttttacgacgtg

SEQ ID NO: 6313 - DNA, 336 bp, Artificial Sequence; identical to SEQ ID NO: 4537
  Description of Artificial Sequence: Synthetic Light chain variable region nucleic acid sequence

SEQ ID NO: 6314 - protein, 112 aa, Artificial Sequence; identical to SEQ ID NO: 4538
  Description of Artificial Sequence: Synthetic Light chain variable region amino acid sequence

SEQ ID NO: 6315 - protein, 17 aa, Artificial Sequence
  Description of Artificial Sequence: Synthetic Light chain variable region CDR L1 amino acid sequence
KSSQSLLNARTGKNYLA

SEQ ID NO: 6316 - DNA, 51 bp, Artificial Sequence; identical to SEQ ID NO: 4540
  Description of Artificial Sequence: Synthetic Light chain variable region CDR L1 nucleic acid sequence

SEQ ID NO: 6317 - protein, 7 aa, Artificial Sequence
  Description of Artificial Sequence: Synthetic Light chain variable region CDR L2 amino acid sequence
WASTRES

SEQ ID NO: 6318 - DNA, 21 bp, Artificial Sequence
  Description of Artificial Sequence: Synthetic Light chain variable region CDR L2 nucleic acid sequence
tgggcatctacccgggaatcc

SEQ ID NO: 6319 - protein, 8 aa, Artificial Sequence
  Description of Artificial Sequence: Synthetic Light chain variable region CDR L3 amino acid sequence
KQSYSRRT

SEQ ID NO: 6320 - DNA, 24 bp, Artificial Sequence
  Description of Artificial Sequence: Synthetic Light chain variable region CDR L3 nucleic acid sequence
aagcaatcttattctcggagaact

SEQ ID NO: 6321 - DNA, 357 bp, Artificial Sequence
  Description of Artificial Sequence: Synthetic Heavy chain variable region nucleic acid sequence
caggtgcagctggtgcagtctggggctgaggtgaagaagcctggggcctcagtgaaggtctcctgcaaggcttctggattcaacatcaaggactactatatgcactgggtgcgacaggctcctggacaaaggcttgagtggatgggatggatcgaccttgaaaatgctaacacaatctatgacgctaagtttcagggcagggtcaccataaccagggacacgtccgccagcacagcctacatggagctgagcagcctgagatctgaagacacggcggtgtactactgcgtgagagatcttcgggggagatatttttacgacgtgtggggccaaggaaccctggtcaccgtctcctca

SEQ ID NO: 6322 - protein, 119 aa, Artificial Sequence
  Description of Artificial Sequence: Synthetic Heavy chain variable region amino acid sequence
QVQLVQSGAEVKKPGASVKVSCKASGFNIKDYYMHWVRQAPGQRLEWMGWIDLENANTIYDAKFQGRVTITRDTSASTAYMELSSLRSEDTAVYYCVRDLRGRYFYDVWGQGTLVTVSS

SEQ ID NO: 6323 - protein, 9 aa, Artificial Sequence
  Description of Artificial Sequence: Synthetic Heavy chain variable region CDR H1 amino acid sequence
FNIKDYYMH

SEQ ID NO: 6324 - DNA, 27 bp, Artificial Sequence
  Description of Artificial Sequence: Synthetic Heavy chain variable region CDR H1 nucleic acid sequence
ttcaacatcaaggactactatatgcac

SEQ ID NO: 6325 - protein, 17 aa, Artificial Sequence
  Description of Artificial Sequence: Synthetic Heavy chain variable region CDR H2 amino acid sequence
WIDLENANTIYDAKFQG

SEQ ID NO: 6326 - DNA, 51 bp, Artificial Sequence; identical to SEQ ID NO: 4662
  Description of Artificial Sequence: Synthetic Heavy chain variable region CDR H2 nucleic acid sequence

SEQ ID NO: 6327 - protein, 12 aa, Artificial Sequence
  Description of Artificial Sequence: Synthetic Heavy chain variable region CDR H3 amino acid sequence
VRDLRGRYFYDV

SEQ ID NO: 6328 - DNA, 36 bp, Artificial Sequence
  Description of Artificial Sequence: Synthetic Heavy chain variable region CDR H3 nucleic acid sequence
gtgagagatcttcgggggagatatttttacgacgtg

SEQ ID NO: 6329 - DNA, 336 bp, Artificial Sequence; identical to SEQ ID NO: 4537
  Description of Artificial Sequence: Synthetic Light chain variable region nucleic acid sequence

SEQ ID NO: 6330 - protein, 112 aa, Artificial Sequence; identical to SEQ ID NO: 4538
  Description of Artificial Sequence: Synthetic Light chain variable region amino acid sequence

SEQ ID NO: 6331 - protein, 17 aa, Artificial Sequence
  Description of Artificial Sequence: Synthetic Light chain variable region CDR L1 amino acid sequence
KSSQSLLNARTGKNYLA

SEQ ID NO: 6332 - DNA, 51 bp, Artificial Sequence; identical to SEQ ID NO: 4540
  Description of Artificial Sequence: Synthetic Light chain variable region CDR L1 nucleic acid sequence

SEQ ID NO: 6333 - protein, 7 aa, Artificial Sequence
  Description of Artificial Sequence: Synthetic Light chain variable region CDR L2 amino acid sequence
WASTRES

SEQ ID NO: 6334 - DNA, 21 bp, Artificial Sequence
  Description of Artificial Sequence: Synthetic Light chain variable region CDR L2 nucleic acid sequence
tgggcatctacccgggaatcc

SEQ ID NO: 6335 - protein, 8 aa, Artificial Sequence
  Description of Artificial Sequence: Synthetic Light chain variable region CDR L3 amino acid sequence
KQSYSRRT

SEQ ID NO: 6336 - DNA, 24 bp, Artificial Sequence
  Description of Artificial Sequence: Synthetic Light chain variable region CDR L3 nucleic acid sequence
aagcaatcttattctcggagaact

SEQ ID NO: 6337 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcaagctgtatctgcaaatggaaagcctgagagccgaggacacggcggtgtactactgcgtcaggcacggtaacttcgggggtggttacgtatcctggtttgctcattggggccaaggaaccctggtcaccgtctcctca

SEQ ID NO: 6338 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSKLYLQMESLRAEDTAVYYCVRHGNFGGGYVSWFAHWGQGTLVTVSS

SEQ ID NO: 6339 - protein, 9 aa, Artificial Sequence
  Description of Artificial Sequence: Synthetic Heavy chain variable region CDR H1 amino acid sequence
FTFDTYAMN

SEQ ID NO: 6340 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 6341 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6342 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6343 - protein, 16 aa, Artificial Sequence
  Description of Artificial Sequence: Synthetic Heavy chain variable region CDR H3 amino acid sequence
VRHGNFGGGYVSWFAH

SEQ ID NO: 6344 - DNA, 48 bp, Artificial Sequence
  Description of Artificial Sequence: Synthetic Heavy chain variable region CDR H3 nucleic acid sequence
gtcaggcacggtaacttcgggggtggttacgtatcctggtttgctcat

SEQ ID NO: 6345 - DNA, 327 bp, Artificial Sequence; identical to SEQ ID NO: 345
  Description of Artificial Sequence: Synthetic Light chain variable region nucleic acid sequence

SEQ ID NO: 6346 - protein, 109 aa, Artificial Sequence; identical to SEQ ID NO: 346
  Description of Artificial Sequence: Synthetic Light chain variable region amino acid sequence

SEQ ID NO: 6347 - protein, 14 aa, Artificial Sequence
  Description of Artificial Sequence: Synthetic Light chain variable region CDR L1 amino acid sequence
GSSTGAVTTSNYAN

SEQ ID NO: 6348 - DNA, 42 bp, Artificial Sequence; identical to SEQ ID NO: 204
  Description of Artificial Sequence: Synthetic Light chain variable region CDR L1 nucleic acid sequence

SEQ ID NO: 6349 - protein, 7 aa, Artificial Sequence
  Description of Artificial Sequence: Synthetic Light chain variable region CDR L2 amino acid sequence
GTDKRAP

SEQ ID NO: 6350 - DNA, 21 bp, Artificial Sequence
  Description of Artificial Sequence: Synthetic Light chain variable region CDR L2 nucleic acid sequence
ggcacagacaagcgcgctcct

SEQ ID NO: 6351 - protein, 9 aa, Artificial Sequence
  Description of Artificial Sequence: Synthetic Light chain variable region CDR L3 amino acid sequence
ALWYSNHWV

SEQ ID NO: 6352 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 6353 - DNA, 375 bp, Artificial Sequence
  Description of Artificial Sequence: Synthetic Heavy chain variable region nucleic acid sequence
gaggtgcagctgttggggtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttcgggaactcgtacgtttcctggtttgctcattggggccaaggaaccctggtcaccgtctcctca

SEQ ID NO: 6354 - protein, 125 aa, Artificial Sequence
  Description of Artificial Sequence: Synthetic Heavy chain variable region amino acid sequence
EVQLLGSGGGLVQPGGSLRLSCAASGFTFDTYAMNWVRQAPGKGLEWVARIRSKYNNYATYYADSVKDRFTISRDDSKSTLYLQMESLRAEDTAVYYCVRHGNFGNSYVSWFAHWGQGTLVTVSS

SEQ ID NO: 6355 - protein, 9 aa, Artificial Sequence
  Description of Artificial Sequence: Synthetic Heavy chain variable region CDR H1 amino acid sequence
FTFDTYAMN

SEQ ID NO: 6356 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 6357 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6358 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6359 - protein, 16 aa, Artificial Sequence
  Description of Artificial Sequence: Synthetic Heavy chain variable region CDR H3 amino acid sequence
VRHGNFGNSYVSWFAH

SEQ ID NO: 6360 - DNA, 48 bp, Artificial Sequence
  Description of Artificial Sequence: Synthetic Heavy chain variable region CDR H3 nucleic acid sequence
gtcaggcacggtaacttcgggaactcgtacgtttcctggtttgctcat

SEQ ID NO: 6361 - DNA, 327 bp, Artificial Sequence; identical to SEQ ID NO: 345
  Description of Artificial Sequence: Synthetic Light chain variable region nucleic acid sequence

SEQ ID NO: 6362 - protein, 109 aa, Artificial Sequence; identical to SEQ ID NO: 346
  Description of Artificial Sequence: Synthetic Light chain variable region amino acid sequence

SEQ ID NO: 6363 - protein, 14 aa, Artificial Sequence
  Description of Artificial Sequence: Synthetic Light chain variable region CDR L1 amino acid sequence
GSSTGAVTTSNYAN

SEQ ID NO: 6364 - DNA, 42 bp, Artificial Sequence; identical to SEQ ID NO: 204
  Description of Artificial Sequence: Synthetic Light chain variable region CDR L1 nucleic acid sequence

SEQ ID NO: 6365 - protein, 7 aa, Artificial Sequence
  Description of Artificial Sequence: Synthetic Light chain variable region CDR L2 amino acid sequence
GTDKRAP

SEQ ID NO: 6366 - DNA, 21 bp, Artificial Sequence
  Description of Artificial Sequence: Synthetic Light chain variable region CDR L2 nucleic acid sequence
ggcacagacaagcgcgctcct

SEQ ID NO: 6367 - protein, 9 aa, Artificial Sequence
  Description of Artificial Sequence: Synthetic Light chain variable region CDR L3 amino acid sequence
ALWYSNHWV

SEQ ID NO: 6368 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 6369 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttcggtgggggttacgtagcctggtttgctcattggggccaaggaaccctggtcaccgtctcctca

SEQ ID NO: 6370 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHGNFGGGYVAWFAHWGQGTLVTVSS

SEQ ID NO: 6371 - protein, 9 aa, Artificial Sequence
  Description of Artificial Sequence: Synthetic Heavy chain variable region CDR H1 amino acid sequence
FTFDTYAMN

SEQ ID NO: 6372 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 6373 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6374 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6375 - protein, 16 aa, Artificial Sequence
  Description of Artificial Sequence: Synthetic Heavy chain variable region CDR H3 amino acid sequence
VRHGNFGGGYVAWFAH

SEQ ID NO: 6376 - DNA, 48 bp, Artificial Sequence
  Description of Artificial Sequence: Synthetic Heavy chain variable region CDR H3 nucleic acid sequence
gtcaggcacggtaacttcggtgggggttacgtagcctggtttgctcat

SEQ ID NO: 6377 - DNA, 327 bp, Artificial Sequence; identical to SEQ ID NO: 345
  Description of Artificial Sequence: Synthetic Light chain variable region nucleic acid sequence

SEQ ID NO: 6378 - protein, 109 aa, Artificial Sequence; identical to SEQ ID NO: 346
  Description of Artificial Sequence: Synthetic Light chain variable region amino acid sequence

SEQ ID NO: 6379 - protein, 14 aa, Artificial Sequence
  Description of Artificial Sequence: Synthetic Light chain variable region CDR L1 amino acid sequence
GSSTGAVTTSNYAN

SEQ ID NO: 6380 - DNA, 42 bp, Artificial Sequence; identical to SEQ ID NO: 204
  Description of Artificial Sequence: Synthetic Light chain variable region CDR L1 nucleic acid sequence

SEQ ID NO: 6381 - protein, 7 aa, Artificial Sequence
  Description of Artificial Sequence: Synthetic Light chain variable region CDR L2 amino acid sequence
GTDKRAP

SEQ ID NO: 6382 - DNA, 21 bp, Artificial Sequence
  Description of Artificial Sequence: Synthetic Light chain variable region CDR L2 nucleic acid sequence
ggcacagacaagcgcgctcct

SEQ ID NO: 6383 - protein, 9 aa, Artificial Sequence
  Description of Artificial Sequence: Synthetic Light chain variable region CDR L3 amino acid sequence
ALWYSNHWV

SEQ ID NO: 6384 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 6385 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtttaacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttccagggtggttacgtatcctggtttgctcattggggccaaggaaccctggtcaccgtctcctca

SEQ ID NO: 6386 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKFNNYATYYADSVKDRFTISRDDSKSTLYLQMESLRAEDTAVYYCVRHGNFQGGYVSWFAHWGQGTLVTVSS

SEQ ID NO: 6387 - protein, 9 aa, Artificial Sequence
  Description of Artificial Sequence: Synthetic Heavy chain variable region CDR H1 amino acid sequence
FTFDTYAMN

SEQ ID NO: 6388 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 6389 - protein, 19 aa, Artificial Sequence
  Description of Artificial Sequence: Synthetic Heavy chain variable region CDR H2 amino acid sequence
RIRSKFNNYATYYADSVKD

SEQ ID NO: 6390 - DNA, 57 bp, Artificial Sequence
  Description of Artificial Sequence: Synthetic Heavy chain variable region CDR H2 nucleic acid sequence
aggattagatccaagtttaacaattacgctacatactacgcagactccgtgaaggat

SEQ ID NO: 6391 - protein, 16 aa, Artificial Sequence
  Description of Artificial Sequence: Synthetic Heavy chain variable region CDR H3 amino acid sequence
VRHGNFQGGYVSWFAH

SEQ ID NO: 6392 - DNA, 48 bp, Artificial Sequence; identical to SEQ ID NO: 1064
  Description of Artificial Sequence: Synthetic Heavy chain variable region CDR H3 nucleic acid sequence

SEQ ID NO: 6393 - DNA, 327 bp, Artificial Sequence; identical to SEQ ID NO: 345
  Description of Artificial Sequence: Synthetic Light chain variable region nucleic acid sequence

SEQ ID NO: 6394 - protein, 109 aa, Artificial Sequence; identical to SEQ ID NO: 346
  Description of Artificial Sequence: Synthetic Light chain variable region amino acid sequence

SEQ ID NO: 6395 - protein, 14 aa, Artificial Sequence
  Description of Artificial Sequence: Synthetic Light chain variable region CDR L1 amino acid sequence
GSSTGAVTTSNYAN

SEQ ID NO: 6396 - DNA, 42 bp, Artificial Sequence; identical to SEQ ID NO: 204
  Description of Artificial Sequence: Synthetic Light chain variable region CDR L1 nucleic acid sequence

SEQ ID NO: 6397 - protein, 7 aa, Artificial Sequence
  Description of Artificial Sequence: Synthetic Light chain variable region CDR L2 amino acid sequence
GTDKRAP

SEQ ID NO: 6398 - DNA, 21 bp, Artificial Sequence
  Description of Artificial Sequence: Synthetic Light chain variable region CDR L2 nucleic acid sequence
ggcacagacaagcgcgctcct

SEQ ID NO: 6399 - protein, 9 aa, Artificial Sequence
  Description of Artificial Sequence: Synthetic Light chain variable region CDR L3 amino acid sequence
ALWYSNHWV

SEQ ID NO: 6400 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 6401 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacgtggggggtggttacgtatcctggtttgctcattggggccaaggaaccctggtcaccgtctcctca

SEQ ID NO: 6402 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHGNVGGGYVSWFAHWGQGTLVTVSS

SEQ ID NO: 6403 - protein, 9 aa, Artificial Sequence
  Description of Artificial Sequence: Synthetic Heavy chain variable region CDR H1 amino acid sequence
FTFDTYAMN

SEQ ID NO: 6404 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 6405 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6406 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6407 - protein, 16 aa, Artificial Sequence
  Description of Artificial Sequence: Synthetic Heavy chain variable region CDR H3 amino acid sequence
VRHGNVGGGYVSWFAH

SEQ ID NO: 6408 - DNA, 48 bp, Artificial Sequence; identical to SEQ ID NO: 1416
  Description of Artificial Sequence: Synthetic Heavy chain variable region CDR H3 nucleic acid sequence

SEQ ID NO: 6409 - DNA, 327 bp, Artificial Sequence; identical to SEQ ID NO: 345
  Description of Artificial Sequence: Synthetic Light chain variable region nucleic acid sequence

SEQ ID NO: 6410 - protein, 109 aa, Artificial Sequence; identical to SEQ ID NO: 346
  Description of Artificial Sequence: Synthetic Light chain variable region amino acid sequence

SEQ ID NO: 6411 - protein, 14 aa, Artificial Sequence
  Description of Artificial Sequence: Synthetic Light chain variable region CDR L1 amino acid sequence
GSSTGAVTTSNYAN

SEQ ID NO: 6412 - DNA, 42 bp, Artificial Sequence; identical to SEQ ID NO: 204
  Description of Artificial Sequence: Synthetic Light chain variable region CDR L1 nucleic acid sequence

SEQ ID NO: 6413 - protein, 7 aa, Artificial Sequence
  Description of Artificial Sequence: Synthetic Light chain variable region CDR L2 amino acid sequence
GTDKRAP

SEQ ID NO: 6414 - DNA, 21 bp, Artificial Sequence
  Description of Artificial Sequence: Synthetic Light chain variable region CDR L2 nucleic acid sequence
ggcacagacaagcgcgctcct

SEQ ID NO: 6415 - protein, 9 aa, Artificial Sequence
  Description of Artificial Sequence: Synthetic Light chain variable region CDR L3 amino acid sequence
ALWYSNHWV

SEQ ID NO: 6416 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 6417 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacgataacttcggggctggttacgtatcctggtttgctcattggggccaaggaaccctggtcaccgtctcctca

SEQ ID NO: 6418 - protein, 125 aa, Artificial Sequence; identical to SEQ ID NO: 1122
  Description of Artificial Sequence: Synthetic Heavy chain variable region amino acid sequence

SEQ ID NO: 6419 - protein, 9 aa, Artificial Sequence
  Description of Artificial Sequence: Synthetic Heavy chain variable region CDR H1 amino acid sequence
FTFDTYAMN

SEQ ID NO: 6420 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 6421 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6422 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6423 - protein, 16 aa, Artificial Sequence
  Description of Artificial Sequence: Synthetic Heavy chain variable region CDR H3 amino acid sequence
VRHDNFGAGYVSWFAH

SEQ ID NO: 6424 - DNA, 48 bp, Artificial Sequence; identical to SEQ ID NO: 1128
  Description of Artificial Sequence: Synthetic Heavy chain variable region CDR H3 nucleic acid sequence

SEQ ID NO: 6425 - DNA, 327 bp, Artificial Sequence; identical to SEQ ID NO: 345
  Description of Artificial Sequence: Synthetic Light chain variable region nucleic acid sequence

SEQ ID NO: 6426 - protein, 109 aa, Artificial Sequence; identical to SEQ ID NO: 346
  Description of Artificial Sequence: Synthetic Light chain variable region amino acid sequence

SEQ ID NO: 6427 - protein, 14 aa, Artificial Sequence
  Description of Artificial Sequence: Synthetic Light chain variable region CDR L1 amino acid sequence
GSSTGAVTTSNYAN

SEQ ID NO: 6428 - DNA, 42 bp, Artificial Sequence; identical to SEQ ID NO: 204
  Description of Artificial Sequence: Synthetic Light chain variable region CDR L1 nucleic acid sequence

SEQ ID NO: 6429 - protein, 7 aa, Artificial Sequence
  Description of Artificial Sequence: Synthetic Light chain variable region CDR L2 amino acid sequence
GTDKRAP

SEQ ID NO: 6430 - DNA, 21 bp, Artificial Sequence
  Description of Artificial Sequence: Synthetic Light chain variable region CDR L2 nucleic acid sequence
ggcacagacaagcgcgctcct

SEQ ID NO: 6431 - protein, 9 aa, Artificial Sequence
  Description of Artificial Sequence: Synthetic Light chain variable region CDR L3 amino acid sequence
ALWYSNHWV

SEQ ID NO: 6432 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 6433 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttcggggttggttacgtatcctggtttgcttcttggggccaaggaaccctggtcaccgtctcctca

SEQ ID NO: 6434 - protein, 125 aa, Artificial Sequence; identical to SEQ ID NO: 1138
  Description of Artificial Sequence: Synthetic Heavy chain variable region amino acid sequence

SEQ ID NO: 6435 - protein, 9 aa, Artificial Sequence
  Description of Artificial Sequence: Synthetic Heavy chain variable region CDR H1 amino acid sequence
FTFDTYAMN

SEQ ID NO: 6436 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 6437 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6438 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6439 - protein, 16 aa, Artificial Sequence
  Description of Artificial Sequence: Synthetic Heavy chain variable region CDR H3 amino acid sequence
VRHGNFGVGYVSWFAS

SEQ ID NO: 6440 - DNA, 48 bp, Artificial Sequence; identical to SEQ ID NO: 1144
  Description of Artificial Sequence: Synthetic Heavy chain variable region CDR H3 nucleic acid sequence

SEQ ID NO: 6441 - DNA, 327 bp, Artificial Sequence; identical to SEQ ID NO: 345
  Description of Artificial Sequence: Synthetic Light chain variable region nucleic acid sequence

SEQ ID NO: 6442 - protein, 109 aa, Artificial Sequence; identical to SEQ ID NO: 346
  Description of Artificial Sequence: Synthetic Light chain variable region amino acid sequence

SEQ ID NO: 6443 - protein, 14 aa, Artificial Sequence
  Description of Artificial Sequence: Synthetic Light chain variable region CDR L1 amino acid sequence
GSSTGAVTTSNYAN

SEQ ID NO: 6444 - DNA, 42 bp, Artificial Sequence; identical to SEQ ID NO: 204
  Description of Artificial Sequence: Synthetic Light chain variable region CDR L1 nucleic acid sequence

SEQ ID NO: 6445 - protein, 7 aa, Artificial Sequence
  Description of Artificial Sequence: Synthetic Light chain variable region CDR L2 amino acid sequence
GTDKRAP

SEQ ID NO: 6446 - DNA, 21 bp, Artificial Sequence
  Description of Artificial Sequence: Synthetic Light chain variable region CDR L2 nucleic acid sequence
ggcacagacaagcgcgctcct

SEQ ID NO: 6447 - protein, 9 aa, Artificial Sequence
  Description of Artificial Sequence: Synthetic Light chain variable region CDR L3 amino acid sequence
ALWYSNHWV

SEQ ID NO: 6448 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 6449 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggttggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtaacttcgggaactatgctgtatcctggtttgctcattggggccaaggaaccctggtcaccgtctcctca

SEQ ID NO: 6450 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHGNFGNYAVSWFAHWGQGTLVTVSS

SEQ ID NO: 6451 - protein, 9 aa, Artificial Sequence
  Description of Artificial Sequence: Synthetic Heavy chain variable region CDR H1 amino acid sequence
FTFDTYAMN

SEQ ID NO: 6452 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 6453 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6454 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6455 - protein, 16 aa, Artificial Sequence
  Description of Artificial Sequence: Synthetic Heavy chain variable region CDR H3 amino acid sequence
VRHGNFGNYAVSWFAH

SEQ ID NO: 6456 - DNA, 48 bp, Artificial Sequence; identical to SEQ ID NO: 1240
  Description of Artificial Sequence: Synthetic Heavy chain variable region CDR H3 nucleic acid sequence

SEQ ID NO: 6457 - DNA, 327 bp, Artificial Sequence; identical to SEQ ID NO: 345
  Description of Artificial Sequence: Synthetic Light chain variable region nucleic acid sequence

SEQ ID NO: 6458 - protein, 109 aa, Artificial Sequence; identical to SEQ ID NO: 346
  Description of Artificial Sequence: Synthetic Light chain variable region amino acid sequence

SEQ ID NO: 6459 - protein, 14 aa, Artificial Sequence
  Description of Artificial Sequence: Synthetic Light chain variable region CDR L1 amino acid sequence
GSSTGAVTTSNYAN

SEQ ID NO: 6460 - DNA, 42 bp, Artificial Sequence; identical to SEQ ID NO: 204
  Description of Artificial Sequence: Synthetic Light chain variable region CDR L1 nucleic acid sequence

SEQ ID NO: 6461 - protein, 7 aa, Artificial Sequence
  Description of Artificial Sequence: Synthetic Light chain variable region CDR L2 amino acid sequence
GTDKRAP

SEQ ID NO: 6462 - DNA, 21 bp, Artificial Sequence
  Description of Artificial Sequence: Synthetic Light chain variable region CDR L2 nucleic acid sequence
ggcacagacaagcgcgctcct

SEQ ID NO: 6463 - protein, 9 aa, Artificial Sequence
  Description of Artificial Sequence: Synthetic Light chain variable region CDR L3 amino acid sequence
ALWYSNHWV

SEQ ID NO: 6464 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 6465 - DNA, 375 bp, Artificial Sequence
  Description of Artificial Sequence: Synthetic Heavy chain variable region nucleic acid sequence
gaggtgcagctgttggagtctgggggaggcttggtacagcctggggggtccctgagactctcctgtgcagcctctggattcacctttgacacatatgccatgaattgggttcgccaggctccagggaaggggctggagtgggtcgcaaggattagatccaagtataacaattacgctacatactacgcagactccgtgaaggatcggttcaccatctccagagacgattccaagagcacgctgtatctgcaaatggaaagcctgagagccgaggacacggcggtgtactactgcgtcaggcacggtagcttcgggaaccatattgtatcctggtttgctcattggggccaaggaaccctggtcaccgtctcctca

SEQ ID NO: 6466 - protein, 125 aa, Artificial Sequence
  Description of Artificial Sequence: Synthetic Heavy chain variable region amino acid sequence
EVQLLESGGGLVQPGGSLRLSCAASGFTFDTYAMNWVRQAPGKGLEWVARIRSKYNNYATYYADSVKDRFTISRDDSKSTLYLQMESLRAEDTAVYYCVRHGSFGNHIVSWFAHWGQGTLVTVSS

SEQ ID NO: 6467 - protein, 9 aa, Artificial Sequence
  Description of Artificial Sequence: Synthetic Heavy chain variable region CDR H1 amino acid sequence
FTFDTYAMN

SEQ ID NO: 6468 - DNA, 27 bp, Artificial Sequence
  Description of Artificial Sequence: Synthetic Heavy chain variable region CDR H1 nucleic acid sequence
ttcacctttgacacatatgccatgaat

SEQ ID NO: 6469 - protein, 19 aa, Artificial Sequence
  Description of Artificial Sequence: Synthetic Heavy chain variable region CDR H2 amino acid sequence
RIRSKYNNYATYYADSVKD

SEQ ID NO: 6470 - DNA, 57 bp, Artificial Sequence; identical to SEQ ID NO: 6
  Description of Artificial Sequence: Synthetic Heavy chain variable region CDR H2 nucleic acid sequence

SEQ ID NO: 6471 - protein, 16 aa, Artificial Sequence
  Description of Artificial Sequence: Synthetic Heavy chain variable region CDR H3 amino acid sequence
VRHGSFGNHIVSWFAH

SEQ ID NO: 6472 - DNA, 48 bp, Artificial Sequence
  Description of Artificial Sequence: Synthetic Heavy chain variable region CDR H3 nucleic acid sequence
gtcaggcacggtagcttcgggaaccatattgtatcctggtttgctcat

SEQ ID NO: 6473 - DNA, 327 bp, Artificial Sequence; identical to SEQ ID NO: 345
  Description of Artificial Sequence: Synthetic Light chain variable region nucleic acid sequence

SEQ ID NO: 6474 - protein, 109 aa, Artificial Sequence; identical to SEQ ID NO: 346
  Description of Artificial Sequence: Synthetic Light chain variable region amino acid sequence

SEQ ID NO: 6475 - protein, 14 aa, Artificial Sequence
  Description of Artificial Sequence: Synthetic Light chain variable region CDR L1 amino acid sequence
GSSTGAVTTSNYAN

SEQ ID NO: 6476 - DNA, 42 bp, Artificial Sequence; identical to SEQ ID NO: 204
  Description of Artificial Sequence: Synthetic Light chain variable region CDR L1 nucleic acid sequence

SEQ ID NO: 6477 - protein, 7 aa, Artificial Sequence
  Description of Artificial Sequence: Synthetic Light chain variable region CDR L2 amino acid sequence
GTDKRAP

SEQ ID NO: 6478 - DNA, 21 bp, Artificial Sequence
  Description of Artificial Sequence: Synthetic Light chain variable region CDR L2 nucleic acid sequence
ggcacagacaagcgcgctcct

SEQ ID NO: 6479 - protein, 9 aa, Artificial Sequence
  Description of Artificial Sequence: Synthetic Light chain variable region CDR L3 amino acid sequence
ALWYSNHWV

SEQ ID NO: 6480 - DNA, 27 bp, Artificial Sequence
  Description of Artificial Sequence: Synthetic Light chain variable region CDR L3 nucleic acid sequence
gcgctgtggtacagtaaccattgggtg

SEQ ID NO: 6481 - protein, 17 aa, Artificial Sequence
  CDRH2 fragment
  misc_feature (6)..(6): Xaa is independently any amino acid
  misc_feature (7)..(7): Xaa is independently any amino acid
WIDLEXXNTIYDAKFQG

SEQ ID NO: 6482 - protein, 9 aa, Artificial Sequence
  Description of Artificial Sequence: Synthetic peptide
YTFTTYYIH

SEQ ID NO: 6483 - protein, 17 aa, Artificial Sequence
  Description of Artificial Sequence: Synthetic peptide
WIYPGNVNAKYNEKFKG

SEQ ID NO: 6484 - protein, 30 aa, Artificial Sequence
  Description of Artificial Sequence: Synthetic polypeptide
KATLTADKSSSTAYMQLSSLTSEDSAVYFC

SEQ ID NO: 6485 - protein, 10 aa, Artificial Sequence
  Description of Artificial Sequence: Synthetic peptide
ARDDGYYFDY

SEQ ID NO: 6486 - protein, 8 aa, Artificial Sequence
  Description of Artificial Sequence: Synthetic peptide
KQSYNLRT

SEQ ID NO: 6487 - protein, 9 aa, Artificial Sequence
  Description of Artificial Sequence: Synthetic peptide
YTFTSYYIH

SEQ ID NO: 6488 - protein, 17 aa, Artificial Sequence
  Description of Artificial Sequence: Synthetic peptide
WIYPGNVNTKYNENFKD

SEQ ID NO: 6489 - protein, 30 aa, Artificial Sequence
  Description of Artificial Sequence: Synthetic polypeptide
KATLTADKSSSTAYMHLSSLTSEDSAVYFC

SEQ ID NO: 6490 - protein, 10 aa, Artificial Sequence
  Description of Artificial Sequence: Synthetic peptide
ARDDGYYFDY

SEQ ID NO: 6491 - protein, 8 aa, Artificial Sequence
  Description of Artificial Sequence: Synthetic peptide
KQSYNLRT

SEQ ID NO: 6492 - protein, 9 aa, Artificial Sequence
  Description of Artificial Sequence: Synthetic peptide
YTFISYYIH

SEQ ID NO: 6493 - protein, 17 aa, Artificial Sequence
  Description of Artificial Sequence: Synthetic peptide
WIYPGNVNTKYNEKFKA

SEQ ID NO: 6494 - protein, 30 aa, Artificial Sequence; identical to SEQ ID NO: 6484
  Description of Artificial Sequence: Synthetic polypeptide

SEQ ID NO: 6495 - protein, 10 aa, Artificial Sequence
  Description of Artificial Sequence: Synthetic peptide
ARDDNYSFAY

SEQ ID NO: 6496 - protein, 8 aa, Artificial Sequence
  Description of Artificial Sequence: Synthetic peptide
KQSYNLRT

SEQ ID NO: 6497 - protein, 9 aa, Artificial Sequence
  Description of Artificial Sequence: Synthetic peptide
YAFTSYYIH

SEQ ID NO: 6498 - protein, 17 aa, Artificial Sequence
  Description of Artificial Sequence: Synthetic peptide
WIYLGDGSTNYNEKFKG

SEQ ID NO: 6499 - protein, 30 aa, Artificial Sequence
  Description of Artificial Sequence: Synthetic polypeptide
KTTLTADKSSSTAYMLLSSLTSEDSATYFC

SEQ ID NO: 6500 - protein, 10 aa, Artificial Sequence
  Description of Artificial Sequence: Synthetic peptide
ARDDSYYFDY

SEQ ID NO: 6501 - protein, 8 aa, Artificial Sequence
  Description of Artificial Sequence: Synthetic peptide
KQSYSLRT

SEQ ID NO: 6502 - protein, 9 aa, Artificial Sequence
  Description of Artificial Sequence: Synthetic peptide
YTFTSYYIH

SEQ ID NO: 6503 - protein, 17 aa, Artificial Sequence
  Description of Artificial Sequence: Synthetic peptide
WIYPGNVNTKYNEKFKG

SEQ ID NO: 6504 - protein, 30 aa, Artificial Sequence; identical to SEQ ID NO: 6484
  Description of Artificial Sequence: Synthetic polypeptide

SEQ ID NO: 6505 - protein, 10 aa, Artificial Sequence
  Description of Artificial Sequence: Synthetic peptide
ARDGDYFFDY

SEQ ID NO: 6506 - protein, 8 aa, Artificial Sequence
  Description of Artificial Sequence: Synthetic peptide
KQSYNLRT

SEQ ID NO: 6507 - protein, 9 aa, Artificial Sequence
  Description of Artificial Sequence: Synthetic peptide
YTFTSYYIH

SEQ ID NO: 6508 - protein, 17 aa, Artificial Sequence
  Description of Artificial Sequence: Synthetic peptide
WIYPGNVNTQYNEKFKG

SEQ ID NO: 6509 - protein, 30 aa, Artificial Sequence
  Description of Artificial Sequence: Synthetic polypeptide
KATLTADKSSSTTYMQLSSLTSEDSAVYFC

SEQ ID NO: 6510 - protein, 10 aa, Artificial Sequence
  Description of Artificial Sequence: Synthetic peptide
ARDGDYYFDY

SEQ ID NO: 6511 - protein, 8 aa, Artificial Sequence
  Description of Artificial Sequence: Synthetic peptide
KQSYNLRT

SEQ ID NO: 6512 - protein, 9 aa, Artificial Sequence
  Description of Artificial Sequence: Synthetic peptide
YTFTRYYIH

SEQ ID NO: 6513 - protein, 17 aa, Artificial Sequence
  Description of Artificial Sequence: Synthetic peptide
WIYPGNVNTKYNEKFKG

SEQ ID NO: 6514 - protein, 30 aa, Artificial Sequence
  Description of Artificial Sequence: Synthetic polypeptide
KATLSADKSSSTAYMQLSSLTSEDSAVYFC

SEQ ID NO: 6515 - protein, 10 aa, Artificial Sequence
  Description of Artificial Sequence: Synthetic peptide
ARDGDYYFDY

SEQ ID NO: 6516 - protein, 8 aa, Artificial Sequence
  Description of Artificial Sequence: Synthetic peptide
KQSYNLRT

SEQ ID NO: 6517 - protein, 9 aa, Artificial Sequence
  Description of Artificial Sequence: Synthetic peptide
YTFTSYYIH

SEQ ID NO: 6518 - protein, 17 aa, Artificial Sequence
  Description of Artificial Sequence: Synthetic peptide
WIYPGNVNTKYNEKFKG

SEQ ID NO: 6519 - protein, 30 aa, Artificial Sequence; identical to SEQ ID NO: 6484
  Description of Artificial Sequence: Synthetic polypeptide

SEQ ID NO: 6520 - protein, 10 aa, Artificial Sequence
  Description of Artificial Sequence: Synthetic peptide
ARDGDYYFDY

SEQ ID NO: 6521 - protein, 8 aa, Artificial Sequence
  Description of Artificial Sequence: Synthetic peptide
KQSYNLRT

SEQ ID NO: 6522 - protein, 9 aa, Artificial Sequence
  Description of Artificial Sequence: Synthetic peptide
YTFTSYYIH

SEQ ID NO: 6523 - protein, 17 aa, Artificial Sequence
  Description of Artificial Sequence: Synthetic peptide
WIYPGNVNTKYNEKFKG

SEQ ID NO: 6524 - protein, 30 aa, Artificial Sequence
  Description of Artificial Sequence: Synthetic polypeptide
KATLTADTSSSTAYMQLSSLTSEDSAVYFC

SEQ ID NO: 6525 - protein, 10 aa, Artificial Sequence
  Description of Artificial Sequence: Synthetic peptide
ARDGNYFFDV

SEQ ID NO: 6526 - protein, 8 aa, Artificial Sequence
  Description of Artificial Sequence: Synthetic peptide
KQSYNLRT

SEQ ID NO: 6527 - protein, 9 aa, Artificial Sequence
  Description of Artificial Sequence: Synthetic peptide
YTFTSYYIH

SEQ ID NO: 6528 - protein, 17 aa, Artificial Sequence
  Description of Artificial Sequence: Synthetic peptide
WIYPGNVNTKYNEKFKG

SEQ ID NO: 6529 - protein, 30 aa, Artificial Sequence
  Description of Artificial Sequence: Synthetic polypeptide
KATLTADKSSSTAYMQLSSLTSEDSAIYFC

SEQ ID NO: 6530 - protein, 10 aa, Artificial Sequence
  Description of Artificial Sequence: Synthetic peptide
ARDGNYFFDV

SEQ ID NO: 6531 - protein, 8 aa, Artificial Sequence
  Description of Artificial Sequence: Synthetic peptide
KQSYNLRT

SEQ ID NO: 6532 - protein, 9 aa, Artificial Sequence
  Description of Artificial Sequence: Synthetic peptide
YTFTSYYIH

SEQ ID NO: 6533 - protein, 17 aa, Artificial Sequence
  Description of Artificial Sequence: Synthetic peptide
WIFPGNVNTKYNEKFKG

SEQ ID NO: 6534 - protein, 30 aa, Artificial Sequence; identical to SEQ ID NO: 6484
  Description of Artificial Sequence: Synthetic polypeptide

SEQ ID NO: 6535 - protein, 10 aa, Artificial Sequence
  Description of Artificial Sequence: Synthetic peptide
ARDGNYSFAY

SEQ ID NO: 6536 - protein, 8 aa, Artificial Sequence
  Description of Artificial Sequence: Synthetic peptide
KQSYNLRT

SEQ ID NO: 6537 - protein, 9 aa, Artificial Sequence
  Description of Artificial Sequence: Synthetic peptide
NTFTSSYIH

SEQ ID NO: 6538 - protein, 17 aa, Artificial Sequence
  Description of Artificial Sequence: Synthetic peptide
WIYPGNVNTKYNEKFKG

SEQ ID NO: 6539 - protein, 30 aa, Artificial Sequence
  Description of Artificial Sequence: Synthetic polypeptide
KATLTADKSSSTVYMQLSSLTSEDSAVYFC

SEQ ID NO: 6540 - protein, 11 aa, Artificial Sequence
  Description of Artificial Sequence: Synthetic peptide
ARDGSSYYFDY

SEQ ID NO: 6541 - protein, 8 aa, Artificial Sequence
  Description of Artificial Sequence: Synthetic peptide
KQSYNLRT

SEQ ID NO: 6542 - protein, 9 aa, Artificial Sequence
  Description of Artificial Sequence: Synthetic peptide
YTFTSYYIH

SEQ ID NO: 6543 - protein, 17 aa, Artificial Sequence
  Description of Artificial Sequence: Synthetic peptide
WIYPGDGSTKYNEKFKG

SEQ ID NO: 6544 - protein, 30 aa, Artificial Sequence
  Description of Artificial Sequence: Synthetic polypeptide
KTTLTADKSSSTAYMLLSSLTSEDSAIYFC

SEQ ID NO: 6545 - protein, 10 aa, Artificial Sequence
  Description of Artificial Sequence: Synthetic peptide
ARDGSYYFDY

SEQ ID NO: 6546 - protein, 8 aa, Artificial Sequence
  Description of Artificial Sequence: Synthetic peptide
KQSYSLRT

SEQ ID NO: 6547 - protein, 9 aa, Artificial Sequence
  Description of Artificial Sequence: Synthetic peptide
YTFTSYYIH

SEQ ID NO: 6548 - protein, 17 aa, Artificial Sequence
  Description of Artificial Sequence: Synthetic peptide
WIYPGNVNTKYNEKFKG

SEQ ID NO: 6549 - protein, 30 aa, Artificial Sequence; identical to SEQ ID NO: 6539
  Description of Artificial Sequence: Synthetic polypeptide

SEQ ID NO: 6550 - protein, 10 aa, Artificial Sequence
  Description of Artificial Sequence: Synthetic peptide
ARDYGYYFDY

SEQ ID NO: 6551 - protein, 8 aa, Artificial Sequence
  Description of Artificial Sequence: Synthetic peptide
KQSYNLRT

SEQ ID NO: 6552 - protein, 9 aa, Artificial Sequence
  Description of Artificial Sequence: Synthetic peptide
YTFTSYYIH

SEQ ID NO: 6553 - protein, 17 aa, Artificial Sequence
  Description of Artificial Sequence: Synthetic peptide
WIYPGDGSTKYNEKFKG

SEQ ID NO: 6554 - protein, 30 aa, Artificial Sequence; identical to SEQ ID NO: 6544
  Description of Artificial Sequence: Synthetic polypeptide

SEQ ID NO: 6555 - protein, 10 aa, Artificial Sequence
  Description of Artificial Sequence: Synthetic peptide
ARDYGYYFDY

SEQ ID NO: 6556 - protein, 8 aa, Artificial Sequence
  Description of Artificial Sequence: Synthetic peptide
KQSYNLRT

SEQ ID NO: 6557 - protein, 9 aa, Artificial Sequence
  Description of Artificial Sequence: Synthetic peptide
YTFTSSYIH

SEQ ID NO: 6558 - protein, 17 aa, Artificial Sequence
  Description of Artificial Sequence: Synthetic peptide
WIYPGNVNTKYNEKFKG

SEQ ID NO: 6559 - protein, 30 aa, Artificial Sequence; identical to SEQ ID NO: 6489
  Description of Artificial Sequence: Synthetic polypeptide

SEQ ID NO: 6560 - protein, 10 aa, Artificial Sequence
  Description of Artificial Sequence: Synthetic peptide
ARDYGYYFDY

SEQ ID NO: 6561 - protein, 8 aa, Artificial Sequence
  Description of Artificial Sequence: Synthetic peptide
KQSYNLRT

SEQ ID NO: 6562 - protein, 9 aa, Artificial Sequence
  Description of Artificial Sequence: Synthetic peptide
YTFTSYYIH

SEQ ID NO: 6563 - protein, 17 aa, Artificial Sequence
  Description of Artificial Sequence: Synthetic peptide
WIYPGNVNTKYNEKFKG

SEQ ID NO: 6564 - protein, 30 aa, Artificial Sequence; identical to SEQ ID NO: 6484
  Description of Artificial Sequence: Synthetic polypeptide

SEQ ID NO: 6565 - protein, 10 aa, Artificial Sequence
  Description of Artificial Sequence: Synthetic peptide
ARDYGYYFGS

SEQ ID NO: 6566 - protein, 8 aa, Artificial Sequence
  Description of Artificial Sequence: Synthetic peptide
KQSYNLRT

SEQ ID NO: 6567 - protein, 9 aa, Artificial Sequence
  Description of Artificial Sequence: Synthetic peptide
FNIKDYYMH

SEQ ID NO: 6568 - protein, 17 aa, Artificial Sequence
  Description of Artificial Sequence: Synthetic peptide
WIDPENGNTIYDPKFQG

SEQ ID NO: 6569 - protein, 30 aa, Artificial Sequence
  Description of Artificial Sequence: Synthetic polypeptide
KASITADTSSNTAYLQLSSLTSEDTAVYYC

SEQ ID NO: 6570 - protein, 12 aa, Artificial Sequence
  Description of Artificial Sequence: Synthetic peptide
ARDGYARYYFDY

SEQ ID NO: 6571 - protein, 8 aa, Artificial Sequence
  Description of Artificial Sequence: Synthetic peptide
KQSYNLRT

SEQ ID NO: 6572 - protein, 9 aa, Artificial Sequence
  Description of Artificial Sequence: Synthetic peptide
YTFTNYYIH

SEQ ID NO: 6573 - protein, 17 aa, Artificial Sequence
  Description of Artificial Sequence: Synthetic peptide
WIYPEDGNTKYNEKFKG

SEQ ID NO: 6574 - protein, 30 aa, Artificial Sequence; identical to SEQ ID NO: 6544
  Description of Artificial Sequence: Synthetic polypeptide

SEQ ID NO: 6575 - protein, 12 aa, Artificial Sequence
  Description of Artificial Sequence: Synthetic peptide
ARNNGSSYAMDY

SEQ ID NO: 6576 - protein, 8 aa, Artificial Sequence
  Description of Artificial Sequence: Synthetic peptide
KQSYNLRT

SEQ ID NO: 6577 - protein, 9 aa, Artificial Sequence
  Description of Artificial Sequence: Synthetic peptide
FNIKDYYMH

SEQ ID NO: 6578 - protein, 17 aa, Artificial Sequence
  Description of Artificial Sequence: Synthetic peptide
WIDPENGNTIYDPKFQG

SEQ ID NO: 6579 - protein, 30 aa, Artificial Sequence; identical to SEQ ID NO: 6569
  Description of Artificial Sequence: Synthetic polypeptide

SEQ ID NO: 6580 - protein, 10 aa, Artificial Sequence
  Description of Artificial Sequence: Synthetic peptide
GRDGNYFFDY

SEQ ID NO: 6581 - protein, 8 aa, Artificial Sequence
  Description of Artificial Sequence: Synthetic peptide
KQSYNLRT

SEQ ID NO: 6582 - protein, 9 aa, Artificial Sequence
  Description of Artificial Sequence: Synthetic peptide
YTFTSYYIH

SEQ ID NO: 6583 - protein, 17 aa, Artificial Sequence
  Description of Artificial Sequence: Synthetic peptide
WIYPGNVNTKYNEKFKG

SEQ ID NO: 6584 - protein, 30 aa, Artificial Sequence; identical to SEQ ID NO: 6539
  Description of Artificial Sequence: Synthetic polypeptide

SEQ ID NO: 6585 - protein, 12 aa, Artificial Sequence
  Description of Artificial Sequence: Synthetic peptide
GRDYYGSYYFDN

SEQ ID NO: 6586 - protein, 8 aa, Artificial Sequence
  Description of Artificial Sequence: Synthetic peptide
KQSYNLRT

SEQ ID NO: 6587 - protein, 9 aa, Artificial Sequence
  Description of Artificial Sequence: Synthetic peptide
FNIKDYYMH

SEQ ID NO: 6588 - protein, 17 aa, Artificial Sequence
  Description of Artificial Sequence: Synthetic peptide
WIDPENGNTIYDPKFQG

SEQ ID NO: 6589 - protein, 30 aa, Artificial Sequence; identical to SEQ ID NO: 6569
  Description of Artificial Sequence: Synthetic polypeptide

SEQ ID NO: 6590 - protein, 12 aa, Artificial Sequence
  Description of Artificial Sequence: Synthetic peptide
ARDGYARYYFDY

SEQ ID NO: 6591 - protein, 8 aa, Artificial Sequence
  Description of Artificial Sequence: Synthetic peptide
KQSYNLRT

SEQ ID NO: 6592 - protein, 9 aa, Artificial Sequence
  Description of Artificial Sequence: Synthetic peptide
YTFTSYYIH

SEQ ID NO: 6593 - protein, 17 aa, Artificial Sequence
  Description of Artificial Sequence: Synthetic peptide
WIYPGDGSTKYNEKFKG

SEQ ID NO: 6594 - protein, 30 aa, Artificial Sequence; identical to SEQ ID NO: 6544
  Description of Artificial Sequence: Synthetic polypeptide

SEQ ID NO: 6595 - protein, 10 aa, Artificial Sequence
  Description of Artificial Sequence: Synthetic peptide
ARDGSYYFDY

SEQ ID NO: 6596 - protein, 8 aa, Artificial Sequence
  Description of Artificial Sequence: Synthetic peptide
KQSYSLRT

SEQ ID NO: 6597 - protein, 9 aa, Artificial Sequence
  Description of Artificial Sequence: Synthetic peptide
YTFTSSYIH

SEQ ID NO: 6598 - protein, 17 aa, Artificial Sequence
  Description of Artificial Sequence: Synthetic peptide
WIYPGNVNTKYNEKFKG

SEQ ID NO: 6599 - protein, 30 aa, Artificial Sequence; identical to SEQ ID NO: 6489
  Description of Artificial Sequence: Synthetic polypeptide

SEQ ID NO: 6600 - protein, 10 aa, Artificial Sequence
  Description of Artificial Sequence: Synthetic peptide
ARDYGYYFDY

SEQ ID NO: 6601 - protein, 8 aa, Artificial Sequence
  Description of Artificial Sequence: Synthetic peptide
KQSYNLRT

SEQ ID NO: 6602 - protein, 106 aa, Artificial Sequence
  Description of Artificial Sequence: Synthetic polypeptide
QVQLVQSGAEVKKPGASVKVSCKASGYTFTSYYIHWVRQAPGQGLEWMGWIYPGDGSTKYNEKFKGRVTMTRDTSTSTVYMELSSLRSEDTAVYYCARDGSYYFDY

SEQ ID NO: 6603 - protein, 8 aa, Artificial Sequence
  Description of Artificial Sequence: Synthetic peptide
KQSYSLRT

SEQ ID NO: 6604 - protein, 106 aa, Artificial Sequence
  Description of Artificial Sequence: Synthetic polypeptide
QVQLVQSGAEVKKPGASVKVSCKASGYTFTSYYIHWVRQAPGQGLEWIGWIYPGDGSTKYNEKFKGRVTMTADKSTSTAYMELSSLRSEDTAVYYCARDGSYYFDY

SEQ ID NO: 6605 - protein, 8 aa, Artificial Sequence
  Description of Artificial Sequence: Synthetic peptide
KQSYSLRT

SEQ ID NO: 6606 - protein, 106 aa, Artificial Sequence
  Description of Artificial Sequence: Synthetic polypeptide
QVQLVQSGAEVKKPGASVKVSCKASGYTFTSYYIHWVRQAPGQGLEWMGWIYPGDGSTKYNEKFKGRVTMTADKSTSTAYMELSSLRSEDTAVYYCARDGSYYFDY

SEQ ID NO: 6607 - protein, 8 aa, Artificial Sequence
  Description of Artificial Sequence: Synthetic peptide
KQSYSLRT

SEQ ID NO: 6608 - protein, 106 aa, Artificial Sequence
  Description of Artificial Sequence: Synthetic polypeptide
QVQLVQSGAEVKKPGASVKVSCKASGYTFTSYYIHWVRQAPGQGLEWIGWIYPGDGSTKYNEKFKGRTTLTADKSTSTAYMELSSLRSEDTAVYYCARDGSYYFDY

SEQ ID NO: 6609 - protein, 8 aa, Artificial Sequence
  Description of Artificial Sequence: Synthetic peptide
KQSYSLRT

SEQ ID NO: 6610 - protein, 106 aa, Artificial Sequence
  Description of Artificial Sequence: Synthetic polypeptide
QVQLVQSGAEVKKPGSSVKVSCKASGYTFTSYYIHWVRQAPGQGLEWIGWIYPGDGSTKYNEKFKGRTTLTADKSTSTAYMELSSLRSEDTAVYYCARDGSYYFDY

SEQ ID NO: 6611 - protein, 8 aa, Artificial Sequence
  Description of Artificial Sequence: Synthetic peptide
KQSYSLRT

SEQ ID NO: 6612 - protein, 106 aa, Artificial Sequence; identical to SEQ ID NO: 6602
  Description of Artificial Sequence: Synthetic polypeptide

SEQ ID NO: 6613 - protein, 8 aa, Artificial Sequence
  Description of Artificial Sequence: Synthetic peptide
KQSYNLRT

SEQ ID NO: 6614 - protein, 106 aa, Artificial Sequence; identical to SEQ ID NO: 6604
  Description of Artificial Sequence: Synthetic polypeptide

SEQ ID NO: 6615 - protein, 8 aa, Artificial Sequence
  Description of Artificial Sequence: Synthetic peptide
KQSYNLRT

SEQ ID NO: 6616 - protein, 106 aa, Artificial Sequence; identical to SEQ ID NO: 6606
  Description of Artificial Sequence: Synthetic polypeptide

SEQ ID NO: 6617 - protein, 8 aa, Artificial Sequence
  Description of Artificial Sequence: Synthetic peptide
KQSYNLRT

SEQ ID NO: 6618 - protein, 106 aa, Artificial Sequence; identical to SEQ ID NO: 6608
  Description of Artificial Sequence: Synthetic polypeptide

SEQ ID NO: 6619 - protein, 8 aa, Artificial Sequence
  Description of Artificial Sequence: Synthetic peptide
KQSYNLRT

SEQ ID NO: 6620 - protein, 106 aa, Artificial Sequence; identical to SEQ ID NO: 6610
  Description of Artificial Sequence: Synthetic polypeptide

SEQ ID NO: 6621 - protein, 8 aa, Artificial Sequence
  Description of Artificial Sequence: Synthetic peptide
KQSYNLRT

SEQ ID NO: 6622 - protein, 106 aa, Artificial Sequence
  Description of Artificial Sequence: Synthetic polypeptide
QVQLVQSGAEVKKPGSSVKVSCKASGYTFTSYYIHWVRQAPGQGLEWMGWIYPGDGSTKYNEKFKGRVTITADKSTSTAYMELSSLRSEDTAVYYCARDGSYYFDY

SEQ ID NO: 6623 - protein, 8 aa, Artificial Sequence
  Description of Artificial Sequence: Synthetic peptide
KQSYSLRT

SEQ ID NO: 6624 - protein, 106 aa, Artificial Sequence; identical to SEQ ID NO: 6622
  Description of Artificial Sequence: Synthetic polypeptide

SEQ ID NO: 6625 - protein, 8 aa, Artificial Sequence
  Description of Artificial Sequence: Synthetic peptide
KQSYNLRT

SEQ ID NO: 6626 - protein, 106 aa, Artificial Sequence
  Description of Artificial Sequence: Synthetic polypeptide
EVQLEQSGPELVKPGASVKMSCKASGYTFTSYYIHWVKQRPGQGLEWIGWIYPGDGSTKYNEKFKGKTTLTADKSSSTAYMLLSSLTSEDSAIYFCARDGSYYFDY

SEQ ID NO: 6627 - protein, 8 aa, Artificial Sequence
  Description of Artificial Sequence: Synthetic peptide
KQSYSLRT

SEQ ID NO: 6628 - protein, 106 aa, Artificial Sequence
  Description of Artificial Sequence: Synthetic polypeptide
QVQLVQSGAEVKKPGASVKVSCKASGYTFTSSYIHWVRQAPGQRLEWMGWIYPGNVNTKYNEKFKGRVTITRDTSASTAYMELSSLRSEDTAVYYCARDYGYYFDY

SEQ ID NO: 6629 - protein, 8 aa, Artificial Sequence
  Description of Artificial Sequence: Synthetic peptide
KQSYSLRT

SEQ ID NO: 6630 - protein, 106 aa, Artificial Sequence
  Description of Artificial Sequence: Synthetic polypeptide
QVQLVQSGAEVKKPGASVKVSCKASGYTFTSSYIHWVRQAPGQGLEWIGWIYPGNVNTKYNEKFKGRATLTADKSASTAYMHLSSLRSEDTAVYYCARDYGYYFDY

SEQ ID NO: 6631 - protein, 8 aa, Artificial Sequence
  Description of Artificial Sequence: Synthetic peptide
KQSYSLRT

SEQ ID NO: 6632 - protein, 106 aa, Artificial Sequence
  Description of Artificial Sequence: Synthetic polypeptide
QVQLVQSGAEVKKPGASVKVSCKASGYTFTSSYIHWVRQAPGQRLEWIGWIYPGNVNTKYNEKFKGRVTITADKSASTAYMELSSLRSEDTAVYYCARDYGYYFDY

SEQ ID NO: 6633 - protein, 8 aa, Artificial Sequence
  Description of Artificial Sequence: Synthetic peptide
KQSYSLRT

SEQ ID NO: 6634 - protein, 106 aa, Artificial Sequence
  Description of Artificial Sequence: Synthetic polypeptide
QVQLVQSGAEVKKPGASVKVSCKASGYTFTSSYIHWVRQAPGQGLEWIGWIYPGNVNTKYNEKFKGRVTMTADKSTSTAYMELSSLRSEDTAVYYCARDYGYYFDY

SEQ ID NO: 6635 - protein, 8 aa, Artificial Sequence
  Description of Artificial Sequence: Synthetic peptide
KQSYSLRT

SEQ ID NO: 6636 - protein, 106 aa, Artificial Sequence
  Description of Artificial Sequence: Synthetic polypeptide
QVQLVQSGAEVKKPGASVKVSCKASGYTFTSSYIHWVRQAPGQGLEWIGWIYPGNVNTKYNEKFKGRATLTADKSTSTAYMHLSSLRSEDTAVYYCARDYGYYFDY

SEQ ID NO: 6637 - protein, 8 aa, Artificial Sequence
  Description of Artificial Sequence: Synthetic peptide
KQSYSLRT

SEQ ID NO: 6638 - protein, 106 aa, Artificial Sequence; identical to SEQ ID NO: 6628
  Description of Artificial Sequence: Synthetic polypeptide

SEQ ID NO: 6639 - protein, 8 aa, Artificial Sequence
  Description of Artificial Sequence: Synthetic peptide
KQSYNLRT

SEQ ID NO: 6640 - protein, 106 aa, Artificial Sequence; identical to SEQ ID NO: 6630
  Description of Artificial Sequence: Synthetic polypeptide

SEQ ID NO: 6641 - protein, 8 aa, Artificial Sequence
  Description of Artificial Sequence: Synthetic peptide
KQSYNLRT

SEQ ID NO: 6642 - protein, 106 aa, Artificial Sequence; identical to SEQ ID NO: 6632
  Description of Artificial Sequence: Synthetic polypeptide

SEQ ID NO: 6643 - protein, 8 aa, Artificial Sequence
  Description of Artificial Sequence: Synthetic peptide
KQSYNLRT

SEQ ID NO: 6644 - protein, 106 aa, Artificial Sequence; identical to SEQ ID NO: 6634
  Description of Artificial Sequence: Synthetic polypeptide

SEQ ID NO: 6645 - protein, 8 aa, Artificial Sequence
  Description of Artificial Sequence: Synthetic peptide
KQSYNLRT

SEQ ID NO: 6646 - protein, 106 aa, Artificial Sequence; identical to SEQ ID NO: 6636
  Description of Artificial Sequence: Synthetic polypeptide

SEQ ID NO: 6647 - protein, 8 aa, Artificial Sequence
  Description of Artificial Sequence: Synthetic peptide
KQSYNLRT

SEQ ID NO: 6648 - protein, 106 aa, Artificial Sequence
  Description of Artificial Sequence: Synthetic polypeptide
QVQLVQSGAEVKKPGASVKVSCKASGYTFTSSYIHWVRQAPGQGLEWMGWIYPGNVNTKYNEKFKGRVTMTRDTSTSTVYMELSSLRSEDTAVYYCARDYGYYFDY

SEQ ID NO: 6649 - protein, 8 aa, Artificial Sequence
  Description of Artificial Sequence: Synthetic peptide
KQSYSLRT

SEQ ID NO: 6650 - protein, 106 aa, Artificial Sequence; identical to SEQ ID NO: 6648
  Description of Artificial Sequence: Synthetic polypeptide

SEQ ID NO: 6651 - protein, 8 aa, Artificial Sequence
  Description of Artificial Sequence: Synthetic peptide
KQSYNLRT

SEQ ID NO: 6652 - protein, 106 aa, Artificial Sequence
  Description of Artificial Sequence: Synthetic polypeptide
EVQLEESGPELVRPGASVRISCKASGYTFTSSYIHWVKQRPGQGLEWIGWIYPGNVNTKYNEKFKGKATLTADKSSSTAYMHLSSLTSEDSAVYFCARDYGYYFDY

SEQ ID NO: 6653 - protein, 8 aa, Artificial Sequence
  Description of Artificial Sequence: Synthetic peptide
KQSYNLRT

SEQ ID NO: 6654 - protein, 108 aa, Artificial Sequence
  Description of Artificial Sequence: Synthetic polypeptide
QVQLVQSGAEVKKPGASVKVSCKASGFNIKDYYMHWVRQAPGQGLEWIGWIDPENGNTIYDPKFQGRATITADTSTNTAYMELSSLRSEDTAVYYCARDGYARYYFDY

SEQ ID NO: 6655 - protein, 8 aa, Artificial Sequence
  Description of Artificial Sequence: Synthetic peptide
KQSYSLRT

SEQ ID NO: 6656 - protein, 108 aa, Artificial Sequence
  Description of Artificial Sequence: Synthetic polypeptide
QVQLVQSGAEVKKPGASVKVSCKASGFNIKDYYMHWVRQAPGQRLEWMGWIDPENGNTIYDPKFQGRVTITRDTSASTAYMELSSLRSEDTAVYYCARDGYARYYFDY

SEQ ID NO: 6657 - protein, 8 aa, Artificial Sequence
  Description of Artificial Sequence: Synthetic peptide
KQSYSLRT

SEQ ID NO: 6658 - protein, 108 aa, Artificial Sequence
  Description of Artificial Sequence: Synthetic polypeptide
QVQLVQSGAEVKKPGASVKVSCKASGFNIKDYYMHWVRQAPGQRLEWIGWIDPENGNTIYDPKFQGRVTITADTSASTAYMELSSLRSEDTAVYYCARDGYARYYFDY

SEQ ID NO: 6659 - protein, 8 aa, Artificial Sequence
  Description of Artificial Sequence: Synthetic peptide
KQSYSLRT

SEQ ID NO: 6660 - protein, 108 aa, Artificial Sequence
  Description of Artificial Sequence: Synthetic polypeptide
QVQLVQSGAEVKKPGASVKVSCKASGFNIKDYYMHWVRQAPGQRLEWIGWIDPENGNTIYDPKFQGRATITADTSANTAYMELSSLRSEDTAVYYCARDGYARYYFDY

SEQ ID NO: 6661 - protein, 8 aa, Artificial Sequence
  Description of Artificial Sequence: Synthetic peptide
KQSYSLRT

SEQ ID NO: 6662 - protein, 108 aa, Artificial Sequence; identical to SEQ ID NO: 6654
  Description of Artificial Sequence: Synthetic polypeptide

SEQ ID NO: 6663 - protein, 8 aa, Artificial Sequence
  Description of Artificial Sequence: Synthetic peptide
KQSYNLRT

SEQ ID NO: 6664 - protein, 108 aa, Artificial Sequence; identical to SEQ ID NO: 6656
  Description of Artificial Sequence: Synthetic polypeptide

SEQ ID NO: 6665 - protein, 8 aa, Artificial Sequence
  Description of Artificial Sequence: Synthetic peptide
KQSYNLRT

SEQ ID NO: 6666 - protein, 108 aa, Artificial Sequence; identical to SEQ ID NO: 6658
  Description of Artificial Sequence: Synthetic polypeptide

SEQ ID NO: 6667 - protein, 8 aa, Artificial Sequence
  Description of Artificial Sequence: Synthetic peptide
KQSYNLRT

SEQ ID NO: 6668 - protein, 108 aa, Artificial Sequence; identical to SEQ ID NO: 6660
  Description of Artificial Sequence: Synthetic polypeptide

SEQ ID NO: 6669 - protein, 8 aa, Artificial Sequence
  Description of Artificial Sequence: Synthetic peptide
KQSYNLRT

SEQ ID NO: 6670 - protein, 108 aa, Artificial Sequence
  Description of Artificial Sequence: Synthetic polypeptide
QVQLVQSGAEVKKPGASVKVSCKASGFNIKDYYMHWVRQAPGQGLEWIGWIDPENGNTIYDPKFQGRVTMTADTSTSTAYMELSSLRSEDTAVYYCARDGYARYYFDY

SEQ ID NO: 6671 - protein, 8 aa, Artificial Sequence
  Description of Artificial Sequence: Synthetic peptide
KQSYNLRT

SEQ ID NO: 6672 - protein, 108 aa, Artificial Sequence
  Description of Artificial Sequence: Synthetic polypeptide
QVQLVQSGAEVKKPGASVKVSCKASGFNIKDYYMHWVRQAPGQGLEWMGWIDPENGNTIYDPKFQGRVTMTRDTSTSTVYMELSSLRSEDTAVYYCARDGYARYYFDY

SEQ ID NO: 6673 - protein, 8 aa, Artificial Sequence
  Description of Artificial Sequence: Synthetic peptide
KQSYNLRT

SEQ ID NO: 6674 - protein, 108 aa, Artificial Sequence; identical to SEQ ID NO: 6670
  Description of Artificial Sequence: Synthetic polypeptide

SEQ ID NO: 6675 - protein, 8 aa, Artificial Sequence
  Description of Artificial Sequence: Synthetic peptide
KQSYSLRT

SEQ ID NO: 6676 - protein, 108 aa, Artificial Sequence; identical to SEQ ID NO: 6672
  Description of Artificial Sequence: Synthetic polypeptide

SEQ ID NO: 6677 - protein, 8 aa, Artificial Sequence
  Description of Artificial Sequence: Synthetic peptide
KQSYSLRT

SEQ ID NO: 6678 - protein, 108 aa, Artificial Sequence
  Description of Artificial Sequence: Synthetic polypeptide
QVQLEQSGAELVRPGALVKLSCKASGFNIKDYYMHWVKQRPEQGLEWIGWIDPENGNTIYDPKFQGKASITADTSSNTAYLQLSSLTSEDTAVYYCARDGYARYYFDY

SEQ ID NO: 6679 - protein, 8 aa, Artificial Sequence
  Description of Artificial Sequence: Synthetic peptide
KQSYNLRT

SEQ ID NO: 6680 - protein, 106 aa, Artificial Sequence; identical to SEQ ID NO: 6606
  Description of Artificial Sequence: Synthetic polypeptide

SEQ ID NO: 6681 - protein, 106 aa, Artificial Sequence; identical to SEQ ID NO: 6626
  Description of Artificial Sequence: Synthetic polypeptide

SEQ ID NO: 6682 - protein, 108 aa, Artificial Sequence; identical to SEQ ID NO: 6656
  Description of Artificial Sequence: Synthetic polypeptide

SEQ ID NO: 6683 - protein, 108 aa, Artificial Sequence; identical to SEQ ID NO: 6658
  Description of Artificial Sequence: Synthetic polypeptide

SEQ ID NO: 6684 - protein, 108 aa, Artificial Sequence; identical to SEQ ID NO: 6678
  Description of Artificial Sequence: Synthetic polypeptide

SEQ ID NO: 6685 - protein, 106 aa, Artificial Sequence; identical to SEQ ID NO: 6632
  Description of Artificial Sequence: Synthetic polypeptide

SEQ ID NO: 6686 - protein, 106 aa, Artificial Sequence; identical to SEQ ID NO: 6636
  Description of Artificial Sequence: Synthetic polypeptide

SEQ ID NO: 6687 - protein, 106 aa, Artificial Sequence; identical to SEQ ID NO: 6652
  Description of Artificial Sequence: Synthetic polypeptide

SEQ ID NO: 6688 - protein, 102 aa, Artificial Sequence
  Description of Artificial Sequence: Synthetic polypeptide
DIVMTQSPDSLAVSLGERATINCKSSQSLLNSRTRKNYLAWYQQKPGQPPKLLIYWASTRESGVPDRFSGSGSGTDFTLTISSLQAEDVAVYYCKQSYSLRT

SEQ ID NO: 6689 - protein, 102 aa, Artificial Sequence
  Description of Artificial Sequence: Synthetic polypeptide
DIQLTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYSLRT

SEQ ID NO: 6690 - protein, 102 aa, Artificial Sequence; identical to SEQ ID NO: 6688
  Description of Artificial Sequence: Synthetic polypeptide

SEQ ID NO: 6691 - protein, 102 aa, Artificial Sequence; identical to SEQ ID NO: 6688
  Description of Artificial Sequence: Synthetic polypeptide

SEQ ID NO: 6692 - protein, 102 aa, Artificial Sequence
  Description of Artificial Sequence: Synthetic polypeptide
DIQLTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLRT

SEQ ID NO: 6693 - protein, 102 aa, Artificial Sequence; identical to SEQ ID NO: 6688
  Description of Artificial Sequence: Synthetic polypeptide

SEQ ID NO: 6694 - protein, 102 aa, Artificial Sequence
  Description of Artificial Sequence: Synthetic polypeptide
DIVMTQSPDSLAVSLGERATINCKSSQSLLNSRTRKNYLAWYQQKPGQPPKLLIYWASTRESGVPDRFSGSGSGTDFTLTISSLQAEDVAVYYCKQSYNLRT

SEQ ID NO: 6695 - protein, 102 aa, Artificial Sequence
  Description of Artificial Sequence: Synthetic polypeptide
DIVLTQSPSSLAVSAGEKVTMSCKSSQSLLNSRTRKNYLAWYQQKAGQSPKLLIYWASTRESGVPDRFTGSGSGTDFTLTISSVQAEDLAVYYCKQSYNLRT

SEQ ID NO: 6696 - protein, 11 aa, Artificial Sequence
  Description of Artificial Sequence: Synthetic peptide
QDGNEEMGGIT

SEQ ID NO: 6697 - protein, 11 aa, Artificial Sequence
  Description of Artificial Sequence: Synthetic peptide
QDGNEEMGSIT

SEQ ID NO: 6698 - protein, 335 aa, Artificial Sequence
  Description of Artificial Sequence: Synthetic polypeptide
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6699 - protein, 315 aa, Artificial Sequence
  Description of Artificial Sequence: Synthetic polypeptide
FKIPIEELEDRVFVNCNTSITWVEGTVGTLLSDITRLDLGKRILDPRGIYRCNGTDIYKDKESTVQVHYRMCQSCVELDGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 6700 - protein, 326 aa, Artificial Sequence
  Description of Artificial Sequence: Synthetic polypeptide
QDGNEEMGSITQTPYQVSISGTTVILTCSQHLGSEAQWQHNGKNKEDSGDRLFLPEFSEMEQSGYYVCYPRGSNPEDASHHLYLKARVCENCMEMDGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6701 - protein, 315 aa, Artificial Sequence
  Description of Artificial Sequence: Synthetic polypeptide
FKIPVEELEDRVFVKCNTSVTWVEGTVGTLLTNNTRLDLGKRILDPRGIYRCNGTDIYKDKESAVQVHYRMCQNCVELDPGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 6702 - protein, 30 aa, Artificial Sequence
  Description of Artificial Sequence: Synthetic polypeptide
  MOD_RES (8)..(9): Any amino acid
DTAVYYCXXDGYARYYFDYWGQGTLVTVSS

SEQ ID NO: 6703 - protein, 30 aa, Artificial Sequence
  Description of Artificial Sequence: Synthetic polypeptide
  MOD_RES (8)..(8): Any amino acid
  MOD_RES (10)..(10): Any amino acid
DTAVYYCXRXGYARYYFDYWGQGTLVTVSS

SEQ ID NO: 6704 - protein, 30 aa, Artificial Sequence
  Description of Artificial Sequence: Synthetic polypeptide
  MOD_RES (8)..(8): Any amino acid
  MOD_RES (11)..(11): Any amino acid
DTAVYYCXRDXYARYYFDYWGQGTLVTVSS

SEQ ID NO: 6705 - protein, 30 aa, Artificial Sequence
  Description of Artificial Sequence: Synthetic polypeptide
  MOD_RES (8)..(8): Any amino acid
  MOD_RES (12)..(12): Any amino acid
DTAVYYCXRDGXARYYFDYWGQGTLVTVSS

SEQ ID NO: 6706 - protein, 30 aa, Artificial Sequence
  Description of Artificial Sequence: Synthetic polypeptide
  MOD_RES (8)..(8): Any amino acid
  MOD_RES (13)..(13): Any amino acid
DTAVYYCXRDGYXRYYFDYWGQGTLVTVSS

SEQ ID NO: 6707 - protein, 30 aa, Artificial Sequence
  Description of Artificial Sequence: Synthetic polypeptide
  MOD_RES (8)..(8): Any amino acid
  MOD_RES (14)..(14): Any amino acid
DTAVYYCXRDGYAXYYFDYWGQGTLVTVSS

SEQ ID NO: 6708 - protein, 30 aa, Artificial Sequence
  Description of Artificial Sequence: Synthetic polypeptide
  MOD_RES (8)..(8): Any amino acid
  MOD_RES (15)..(15): Any amino acid
DTAVYYCXRDGYARXYFDYWGQGTLVTVSS

SEQ ID NO: 6709 - protein, 30 aa, Artificial Sequence
  Description of Artificial Sequence: Synthetic polypeptide
  MOD_RES (8)..(8): Any amino acid
  MOD_RES (16)..(16): Any amino acid
DTAVYYCXRDGYARYXFDYWGQGTLVTVSS

SEQ ID NO: 6710 - protein, 30 aa, Artificial Sequence
  Description of Artificial Sequence: Synthetic polypeptide
  MOD_RES (8)..(8): Any amino acid
  MOD_RES (17)..(17): Any amino acid
DTAVYYCXRDGYARYYXDYWGQGTLVTVSS

SEQ ID NO: 6711 - protein, 30 aa, Artificial Sequence
  Description of Artificial Sequence: Synthetic polypeptide
  MOD_RES (8)..(8): Any amino acid
  MOD_RES (18)..(18): Any amino acid
DTAVYYCXRDGYARYYFXYWGQGTLVTVSS

SEQ ID NO: 6712 - protein, 30 aa, Artificial Sequence
  Description of Artificial Sequence: Synthetic polypeptide
  MOD_RES (8)..(8): Any amino acid
  MOD_RES (19)..(19): Any amino acid
DTAVYYCXRDGYARYYFDXWGQGTLVTVSS

SEQ ID NO: 6713 - protein, 30 aa, Artificial Sequence
  Description of Artificial Sequence: Synthetic polypeptide
  MOD_RES (9)..(10): Any amino acid
DTAVYYCAXXGYARYYFDYWGQGTLVTVSS

SEQ ID NO: 6714 - protein, 30 aa, Artificial Sequence
  Description of Artificial Sequence: Synthetic polypeptide
  MOD_RES (9)..(9): Any amino acid
  MOD_RES (11)..(11): Any amino acid
DTAVYYCAXDXYARYYFDYWGQGTLVTVSS

SEQ ID NO: 6715 - protein, 30 aa, Artificial Sequence
  Description of Artificial Sequence: Synthetic polypeptide
  MOD_RES (9)..(9): Any amino acid
  MOD_RES (12)..(12): Any amino acid
DTAVYYCAXDGXARYYFDYWGQGTLVTVSS

SEQ ID NO: 6716 - protein, 30 aa, Artificial Sequence
  Description of Artificial Sequence: Synthetic polypeptide
  MOD_RES (9)..(9): Any amino acid
  MOD_RES (13)..(13): Any amino acid
DTAVYYCAXDGYXRYYFDYWGQGTLVTVSS

SEQ ID NO: 6717 - protein, 30 aa, Artificial Sequence
  Description of Artificial Sequence: Synthetic polypeptide
  MOD_RES (9)..(9): Any amino acid
  MOD_RES (14)..(14): Any amino acid
DTAVYYCAXDGYAXYYFDYWGQGTLVTVSS

SEQ ID NO: 6718 - protein, 30 aa, Artificial Sequence
  Description of Artificial Sequence: Synthetic polypeptide
  MOD_RES (9)..(9): Any amino acid
  MOD_RES (15)..(15): Any amino acid
DTAVYYCAXDGYARXYFDYWGQGTLVTVSS

SEQ ID NO: 6719 - protein, 30 aa, Artificial Sequence
  Description of Artificial Sequence: Synthetic polypeptide
  MOD_RES (9)..(9): Any amino acid
  MOD_RES (16)..(16): Any amino acid
DTAVYYCAXDGYARYXFDYWGQGTLVTVSS

SEQ ID NO: 6720 - protein, 30 aa, Artificial Sequence
  Description of Artificial Sequence: Synthetic polypeptide
  MOD_RES (9)..(9): Any amino acid
  MOD_RES (17)..(17): Any amino acid
DTAVYYCAXDGYARYYXDYWGQGTLVTVSS

SEQ ID NO: 6721 - protein, 30 aa, Artificial Sequence
  Description of Artificial Sequence: Synthetic polypeptide
  MOD_RES (9)..(9): Any amino acid
  MOD_RES (18)..(18): Any amino acid
DTAVYYCAXDGYARYYFXYWGQGTLVTVSS

SEQ ID NO: 6722 - protein, 30 aa, Artificial Sequence
  Description of Artificial Sequence: Synthetic polypeptide
  MOD_RES (9)..(9): Any amino acid
  MOD_RES (19)..(19): Any amino acid
DTAVYYCAXDGYARYYFDXWGQGTLVTVSS

SEQ ID NO: 6723 - protein, 30 aa, Artificial Sequence
  Description of Artificial Sequence: Synthetic polypeptide
  MOD_RES (10)..(11): Any amino acid
DTAVYYCARXXYARYYFDYWGQGTLVTVSS

SEQ ID NO: 6724 - protein, 30 aa, Artificial Sequence
  Description of Artificial Sequence: Synthetic polypeptide
  MOD_RES (10)..(10): Any amino acid
  MOD_RES (12)..(12): Any amino acid
DTAVYYCARXGXARYYFDYWGQGTLVTVSS

SEQ ID NO: 6725 - protein, 30 aa, Artificial Sequence
  Description of Artificial Sequence: Synthetic polypeptide
  MOD_RES (10)..(10): Any amino acid
  MOD_RES (13)..(13): Any amino acid
DTAVYYCARXGYXRYYFDYWGQGTLVTVSS

SEQ ID NO: 6726 - protein, 30 aa, Artificial Sequence
  Description of Artificial Sequence: Synthetic polypeptide
  MOD_RES (10)..(10): Any amino acid
  MOD_RES (14)..(14): Any amino acid
DTAVYYCARXGYAXYYFDYWGQGTLVTVSS

SEQ ID NO: 6727 - protein, 30 aa, Artificial Sequence
  Description of Artificial Sequence: Synthetic polypeptide
  MOD_RES (10)..(10): Any amino acid
  MOD_RES (15)..(15): Any amino acid
DTAVYYCARXGYARXYFDYWGQGTLVTVSS

SEQ ID NO: 6728 - protein, 30 aa, Artificial Sequence
  Description of Artificial Sequence: Synthetic polypeptide
  MOD_RES (10)..(10): Any amino acid
  MOD_RES (16)..(16): Any amino acid
DTAVYYCARXGYARYXFDYWGQGTLVTVSS

SEQ ID NO: 6729 - protein, 30 aa, Artificial Sequence
  Description of Artificial Sequence: Synthetic polypeptide
  MOD_RES (10)..(10): Any amino acid
  MOD_RES (17)..(17): Any amino acid
DTAVYYCARXGYARYYXDYWGQGTLVTVSS

SEQ ID NO: 6730 - protein, 30 aa, Artificial Sequence
  Description of Artificial Sequence: Synthetic polypeptide
  MOD_RES (10)..(10): Any amino acid
  MOD_RES (18)..(18): Any amino acid
DTAVYYCARXGYARYYFXYWGQGTLVTVSS

SEQ ID NO: 6731 - protein, 30 aa, Artificial Sequence
  Description of Artificial Sequence: Synthetic polypeptide
  MOD_RES (10)..(10): Any amino acid
  MOD_RES (19)..(19): Any amino acid
DTAVYYCARXGYARYYFDXWGQGTLVTVSS

SEQ ID NO: 6732 - protein, 30 aa, Artificial Sequence
  Description of Artificial Sequence: Synthetic polypeptide
  MOD_RES (11)..(12): Any amino acid
DTAVYYCARDXXARYYFDYWGQGTLVTVSS

SEQ ID NO: 6733 - protein, 30 aa, Artificial Sequence
  Description of Artificial Sequence: Synthetic polypeptide
  MOD_RES (11)..(11): Any amino acid
  MOD_RES (13)..(13): Any amino acid
DTAVYYCARDXYXRYYFDYWGQGTLVTVSS

SEQ ID NO: 6734 - protein, 30 aa, Artificial Sequence
  Description of Artificial Sequence: Synthetic polypeptide
  MOD_RES (11)..(11): Any amino acid
  MOD_RES (14)..(14): Any amino acid
DTAVYYCARDXYAXYYFDYWGQGTLVTVSS

SEQ ID NO: 6735 - protein, 30 aa, Artificial Sequence
  Description of Artificial Sequence: Synthetic polypeptide
  MOD_RES (11)..(11): Any amino acid
  MOD_RES (15)..(15): Any amino acid
DTAVYYCARDXYARXYFDYWGQGTLVTVSS

SEQ ID NO: 6736 - protein, 30 aa, Artificial Sequence
  Description of Artificial Sequence: Synthetic polypeptide
  MOD_RES (11)..(11): Any amino acid
  MOD_RES (16)..(16): Any amino acid
DTAVYYCARDXYARYXFDYWGQGTLVTVSS

SEQ ID NO: 6737 - protein, 30 aa, Artificial Sequence
  Description of Artificial Sequence: Synthetic polypeptide
  MOD_RES (11)..(11): Any amino acid
  MOD_RES (17)..(17): Any amino acid
DTAVYYCARDXYARYYXDYWGQGTLVTVSS

SEQ ID NO: 6738 - protein, 30 aa, Artificial Sequence
  Description of Artificial Sequence: Synthetic polypeptide
  MOD_RES (11)..(11): Any amino acid
  MOD_RES (18)..(18): Any amino acid
DTAVYYCARDXYARYYFXYWGQGTLVTVSS

SEQ ID NO: 6739 - protein, 30 aa, Artificial Sequence
  Description of Artificial Sequence: Synthetic polypeptide
  MOD_RES (11)..(11): Any amino acid
  MOD_RES (19)..(19): Any amino acid
DTAVYYCARDXYARYYFDXWGQGTLVTVSS

SEQ ID NO: 6740 - protein, 30 aa, Artificial Sequence
  Description of Artificial Sequence: Synthetic polypeptide
  MOD_RES (12)..(13): Any amino acid
DTAVYYCARDGXXRYYFDYWGQGTLVTVSS

SEQ ID NO: 6741 - protein, 30 aa, Artificial Sequence
  Description of Artificial Sequence: Synthetic polypeptide
  MOD_RES (12)..(12): Any amino acid
  MOD_RES (14)..(14): Any amino acid
DTAVYYCARDGXAXYYFDYWGQGTLVTVSS

SEQ ID NO: 6742 - protein, 30 aa, Artificial Sequence
  Description of Artificial Sequence: Synthetic polypeptide
  MOD_RES (12)..(12): Any amino acid
  MOD_RES (15)..(15): Any amino acid
DTAVYYCARDGXARXYFDYWGQGTLVTVSS

SEQ ID NO: 6743 - protein, 30 aa, Artificial Sequence
  Description of Artificial Sequence: Synthetic polypeptide
  MOD_RES (12)..(12): Any amino acid
  MOD_RES (16)..(16): Any amino acid
DTAVYYCARDGXARYXFDYWGQGTLVTVSS

SEQ ID NO: 6744 - protein, 30 aa, Artificial Sequence
  Description of Artificial Sequence: Synthetic polypeptide
  MOD_RES (12)..(12): Any amino acid
  MOD_RES (17)..(17): Any amino acid
DTAVYYCARDGXARYYXDYWGQGTLVTVSS

SEQ ID NO: 6745 - protein, 30 aa, Artificial Sequence
  Description of Artificial Sequence: Synthetic polypeptide
  MOD_RES (12)..(12): Any amino acid
  MOD_RES (18)..(18): Any amino acid
DTAVYYCARDGXARYYFXYWGQGTLVTVSS

SEQ ID NO: 6746 - protein, 30 aa, Artificial Sequence
  Description of Artificial Sequence: Synthetic polypeptide
  MOD_RES (12)..(12): Any amino acid
  MOD_RES (19)..(19): Any amino acid
DTAVYYCARDGXARYYFDXWGQGTLVTVSS

SEQ ID NO: 6747 - protein, 30 aa, Artificial Sequence
  Description of Artificial Sequence: Synthetic polypeptide
  MOD_RES (13)..(14): Any amino acid
DTAVYYCARDGYXXYYFDYWGQGTLVTVSS

SEQ ID NO: 6748 - protein, 30 aa, Artificial Sequence
  Description of Artificial Sequence: Synthetic polypeptide
  MOD_RES (13)..(13): Any amino acid
  MOD_RES (15)..(15): Any amino acid
DTAVYYCARDGYXRXYFDYWGQGTLVTVSS

SEQ ID NO: 6749 - protein, 30 aa, Artificial Sequence
  Description of Artificial Sequence: Synthetic polypeptide
  MOD_RES (13)..(13): Any amino acid
  MOD_RES (16)..(16): Any amino acid
DTAVYYCARDGYXRYXFDYWGQGTLVTVSS

SEQ ID NO: 6750 - protein, 30 aa, Artificial Sequence
  Description of Artificial Sequence: Synthetic polypeptide
  MOD_RES (13)..(13): Any amino acid
  MOD_RES (17)..(17): Any amino acid
DTAVYYCARDGYXRYYXDYWGQGTLVTVSS

SEQ ID NO: 6751 - protein, 30 aa, Artificial Sequence
  Description of Artificial Sequence: Synthetic polypeptide
  MOD_RES (13)..(13): Any amino acid
  MOD_RES (18)..(18): Any amino acid
DTAVYYCARDGYXRYYFXYWGQGTLVTVSS

SEQ ID NO: 6752 - protein, 30 aa, Artificial Sequence
  Description of Artificial Sequence: Synthetic polypeptide
  MOD_RES (13)..(13): Any amino acid
  MOD_RES (19)..(19): Any amino acid
DTAVYYCARDGYXRYYFDXWGQGTLVTVSS

SEQ ID NO: 6753 - protein, 30 aa, Artificial Sequence
  Description of Artificial Sequence: Synthetic polypeptide
  MOD_RES (14)..(15): Any amino acid
DTAVYYCARDGYAXXYFDYWGQGTLVTVSS

SEQ ID NO: 6754 - protein, 30 aa, Artificial Sequence
  Description of Artificial Sequence: Synthetic polypeptide
  MOD_RES (14)..(14): Any amino acid
  MOD_RES (16)..(16): Any amino acid
DTAVYYCARDGYAXYXFDYWGQGTLVTVSS

SEQ ID NO: 6755 - protein, 30 aa, Artificial Sequence
  Description of Artificial Sequence: Synthetic polypeptide
  MOD_RES (14)..(14): Any amino acid
  MOD_RES (17)..(17): Any amino acid
DTAVYYCARDGYAXYYXDYWGQGTLVTVSS

SEQ ID NO: 6756 - protein, 30 aa, Artificial Sequence
  Description of Artificial Sequence: Synthetic polypeptide
  MOD_RES (14)..(14): Any amino acid
  MOD_RES (18)..(18): Any amino acid
DTAVYYCARDGYAXYYFXYWGQGTLVTVSS

SEQ ID NO: 6757 - protein, 30 aa, Artificial Sequence
  Description of Artificial Sequence: Synthetic polypeptide
  MOD_RES (14)..(14): Any amino acid
  MOD_RES (19)..(19): Any amino acid
DTAVYYCARDGYAXYYFDXWGQGTLVTVSS

SEQ ID NO: 6758 - protein, 30 aa, Artificial Sequence
  Description of Artificial Sequence: Synthetic polypeptide
  MOD_RES (15)..(16): Any amino acid
DTAVYYCARDGYARXXFDYWGQGTLVTVSS

SEQ ID NO: 6759 - protein, 30 aa, Artificial Sequence
  Description of Artificial Sequence: Synthetic polypeptide
  MOD_RES (15)..(15): Any amino acid
  MOD_RES (17)..(17): Any amino acid
DTAVYYCARDGYARXYXDYWGQGTLVTVSS

SEQ ID NO: 6760 - protein, 30 aa, Artificial Sequence
  Description of Artificial Sequence: Synthetic polypeptide
  MOD_RES (15)..(15): Any amino acid
  MOD_RES (18)..(18): Any amino acid
DTAVYYCARDGYARXYFXYWGQGTLVTVSS

SEQ ID NO: 6761 - protein, 30 aa, Artificial Sequence
  Description of Artificial Sequence: Synthetic polypeptide
  MOD_RES (15)..(15): Any amino acid
  MOD_RES (19)..(19): Any amino acid
DTAVYYCARDGYARXYFDXWGQGTLVTVSS

SEQ ID NO: 6762 - protein, 30 aa, Artificial Sequence
  Description of Artificial Sequence: Synthetic polypeptide
  MOD_RES (16)..(17): Any amino acid
DTAVYYCARDGYARYXXDYWGQGTLVTVSS

SEQ ID NO: 6763 - protein, 30 aa, Artificial Sequence
  Description of Artificial Sequence: Synthetic polypeptide
  MOD_RES (16)..(16): Any amino acid
  MOD_RES (18)..(18): Any amino acid
DTAVYYCARDGYARYXFXYWGQGTLVTVSS

SEQ ID NO: 6764 - protein, 30 aa, Artificial Sequence
  Description of Artificial Sequence: Synthetic polypeptide
  MOD_RES (16)..(16): Any amino acid
  MOD_RES (19)..(19): Any amino acid
DTAVYYCARDGYARYXFDXWGQGTLVTVSS

SEQ ID NO: 6765 - protein, 30 aa, Artificial Sequence
  Description of Artificial Sequence: Synthetic polypeptide
  MOD_RES (17)..(18): Any amino acid
DTAVYYCARDGYARYYXXYWGQGTLVTVSS

SEQ ID NO: 6766 - protein, 30 aa, Artificial Sequence
  Description of Artificial Sequence: Synthetic polypeptide
  MOD_RES (17)..(17): Any amino acid
  MOD_RES (19)..(19): Any amino acid
DTAVYYCARDGYARYYXDXWGQGTLVTVSS

SEQ ID NO: 6767 - protein, 30 aa, Artificial Sequence
  Description of Artificial Sequence: Synthetic polypeptide
  MOD_RES (18)..(19): Any amino acid
DTAVYYCARDGYARYYFXXWGQGTLVTVSS

SEQ ID NO: 6768 - protein, 12 aa, Artificial Sequence
  Description of Artificial Sequence: Synthetic peptide
ARDGYARYYFDY

SEQ ID NO: 6769 - protein, 12 aa, Artificial Sequence
  Description of Artificial Sequence: Synthetic peptide
ARDGYGRYYFDY

SEQ ID NO: 6770 - protein, 12 aa, Artificial Sequence
  Description of Artificial Sequence: Synthetic peptide
ARDGYARYYYDY

SEQ ID NO: 6771 - protein, 12 aa, Artificial Sequence
  Description of Artificial Sequence: Synthetic peptide
ARDGYARYFFDY

SEQ ID NO: 6772 - protein, 12 aa, Artificial Sequence
  Description of Artificial Sequence: Synthetic peptide
GSDGYARYYFDY

SEQ ID NO: 6773 - protein, 12 aa, Artificial Sequence
  Description of Artificial Sequence: Synthetic peptide
ARDGYGRYFFDY

SEQ ID NO: 6774 - protein, 12 aa, Artificial Sequence
  Description of Artificial Sequence: Synthetic peptide
ARDGYARYYFDV

SEQ ID NO: 6775 - protein, 12 aa, Artificial Sequence
  Description of Artificial Sequence: Synthetic peptide
SRDGYARYYFDY

SEQ ID NO: 6776 - protein, 12 aa, Artificial Sequence
  Description of Artificial Sequence: Synthetic peptide
ARDGYARYYFDI

SEQ ID NO: 6777 - protein, 12 aa, Artificial Sequence
  Description of Artificial Sequence: Synthetic peptide
NRDGYARYYYDY

SEQ ID NO: 6778 - protein, 12 aa, Artificial Sequence
  Description of Artificial Sequence: Synthetic peptide
ARDGYGRYYFDA

SEQ ID NO: 6779 - protein, 12 aa, Artificial Sequence
  Description of Artificial Sequence: Synthetic peptide
ARDGYARYFFDN

SEQ ID NO: 6780 - protein, 12 aa, Artificial Sequence
  Description of Artificial Sequence: Synthetic peptide
ARDGYGRYYFDR

SEQ ID NO: 6781 - protein, 12 aa, Artificial Sequence
  Description of Artificial Sequence: Synthetic peptide
ARDGYGRYFYDY

SEQ ID NO: 6782 - protein, 12 aa, Artificial Sequence
  Description of Artificial Sequence: Synthetic peptide
ARDGYGRYFYDV

SEQ ID NO: 6783 - protein, 12 aa, Artificial Sequence
  Description of Artificial Sequence: Synthetic peptide
ARDGYGRYFFDV

SEQ ID NO: 6784 - protein, 12 aa, Artificial Sequence
  Description of Artificial Sequence: Synthetic peptide
ARDGYGRYYYDY

SEQ ID NO: 6785 - protein, 12 aa, Artificial Sequence
  Description of Artificial Sequence: Synthetic peptide
ARDGYGRYYYDV

SEQ ID NO: 6786 - protein, 17 aa, Artificial Sequence
  Description of Artificial Sequence: Synthetic peptide
WIDLENGNTIYDPKFQG

SEQ ID NO: 6787 - protein, 12 aa, Artificial Sequence
  Description of Artificial Sequence: Synthetic peptide
ARDGYGRYFYDV

SEQ ID NO: 6788 - protein, 17 aa, Artificial Sequence
  Description of Artificial Sequence: Synthetic peptide
KSSQSLLNSRTGKNYLA

SEQ ID NO: 6789 - protein, 17 aa, Artificial Sequence
  Description of Artificial Sequence: Synthetic peptide
WIDLENANTIYDPKFQG

SEQ ID NO: 6790 - protein, 12 aa, Artificial Sequence
  Description of Artificial Sequence: Synthetic peptide
ARDGYGRYFYDV

SEQ ID NO: 6791 - protein, 17 aa, Artificial Sequence
  Description of Artificial Sequence: Synthetic peptide
KSSQSLLNSRTGKNYLA

SEQ ID NO: 6792 - protein, 17 aa, Artificial Sequence
  Description of Artificial Sequence: Synthetic peptide
WIDLENGNTIYDAKFQG

SEQ ID NO: 6793 - protein, 12 aa, Artificial Sequence
  Description of Artificial Sequence: Synthetic peptide
ARDGYGRYFYDV

SEQ ID NO: 6794 - protein, 17 aa, Artificial Sequence
  Description of Artificial Sequence: Synthetic peptide
KSSQSLLNSRTGKNYLA

SEQ ID NO: 6795 - protein, 17 aa, Artificial Sequence
  Description of Artificial Sequence: Synthetic peptide
WIDLENGNTIYDPKFQG

SEQ ID NO: 6796 - protein, 12 aa, Artificial Sequence
  Description of Artificial Sequence: Synthetic peptide
ARDAYGRYFYDV

SEQ ID NO: 6797 - protein, 17 aa, Artificial Sequence
  Description of Artificial Sequence: Synthetic peptide
KSSQSLLNSRTGKNYLA

SEQ ID NO: 6798 - protein, 17 aa, Artificial Sequence
  Description of Artificial Sequence: Synthetic peptide
WIDLENGNTIYDAKFQG

SEQ ID NO: 6799 - protein, 12 aa, Artificial Sequence
  Description of Artificial Sequence: Synthetic peptide
ARDGYGRYFYDV

SEQ ID NO: 6800 - protein, 17 aa, Artificial Sequence
  Description of Artificial Sequence: Synthetic peptide
KSSQSLLNARTGKNYLA

SEQ ID NO: 6801 - protein, 17 aa, Artificial Sequence
  Description of Artificial Sequence: Synthetic peptide
WIDLENGNTIYDPKFQG

SEQ ID NO: 6802 - protein, 12 aa, Artificial Sequence
  Description of Artificial Sequence: Synthetic peptide
ARDGYGRYFYDV

SEQ ID NO: 6803 - protein, 17 aa, Artificial Sequence
  Description of Artificial Sequence: Synthetic peptide
KSSQSLLNSRTGKNYLA

SEQ ID NO: 6804 - protein, 17 aa, Artificial Sequence
  Description of Artificial Sequence: Synthetic peptide
WIDLENANTIYDAKFQG

SEQ ID NO: 6805 - protein, 12 aa, Artificial Sequence
  Description of Artificial Sequence: Synthetic peptide
ARDAYGRYFYDV

SEQ ID NO: 6806 - protein, 17 aa, Artificial Sequence
  Description of Artificial Sequence: Synthetic peptide
KSSQSLLNARTGKNYLA

SEQ ID NO: 6807 - protein, 30 aa, Artificial Sequence
  Description of Artificial Sequence: Synthetic polypeptide
EDTAVYYCARDGYGRYFYDVWGQGTLVTVS

SEQ ID NO: 6808 - protein, 30 aa, Artificial Sequence
  Description of Artificial Sequence: Synthetic polypeptide
  MOD_RES (9)..(9): Any amino acid
  MOD_RES (11)..(11): Any amino acid
EDTAVYYCXRXGYGRYFYDVWGQGTLVTVS

SEQ ID NO: 6809 - protein, 30 aa, Artificial Sequence
  Description of Artificial Sequence: Synthetic polypeptide
  MOD_RES (9)..(9): Any amino acid
  MOD_RES (12)..(12): Any amino acid
EDTAVYYCXRDXYGRYFYDVWGQGTLVTVS

SEQ ID NO: 6810 - protein, 30 aa, Artificial Sequence
  Description of Artificial Sequence: Synthetic polypeptide
  MOD_RES (10)..(11): Any amino acid
EDTAVYYCAXXGYGRYFYDVWGQGTLVTVS

SEQ ID NO: 6811 - protein, 30 aa, Artificial Sequence
  Description of Artificial Sequence: Synthetic polypeptide
  MOD_RES (10)..(10): Any amino acid
  MOD_RES (12)..(12): Any amino acid
EDTAVYYCAXDXYGRYFYDVWGQGTLVTVS

SEQ ID NO: 6812 - protein, 30 aa, Artificial Sequence
  Description of Artificial Sequence: Synthetic polypeptide
  MOD_RES (11)..(12): Any amino acid
EDTAVYYCARXXYGRYFYDVWGQGTLVTVS

SEQ ID NO: 6813 - protein, 30 aa, Artificial Sequence
  Description of Artificial Sequence: Synthetic polypeptide
  MOD_RES (11)..(11): Any amino acid
  MOD_RES (13)..(13): Any amino acid
EDTAVYYCARXGXGRYFYDVWGQGTLVTVS

SEQ ID NO: 6814 - protein, 30 aa, Artificial Sequence
  Description of Artificial Sequence: Synthetic polypeptide
  MOD_RES (11)..(11): Any amino acid
  MOD_RES (14)..(14): Any amino acid
EDTAVYYCARXGYXRYFYDVWGQGTLVTVS

SEQ ID NO: 6815 - protein, 30 aa, Artificial Sequence
  Description of Artificial Sequence: Synthetic polypeptide
  MOD_RES (11)..(11): Any amino acid
  MOD_RES (15)..(15): Any amino acid
EDTAVYYCARXGYGXYFYDVWGQGTLVTVS

SEQ ID NO: 6816 - protein, 30 aa, Artificial Sequence
  Description of Artificial Sequence: Synthetic polypeptide
  MOD_RES (11)..(11): Any amino acid
  MOD_RES (16)..(16): Any amino acid
EDTAVYYCARXGYGRXFYDVWGQGTLVTVS

SEQ ID NO: 6817 - protein, 30 aa, Artificial Sequence
  Description of Artificial Sequence: Synthetic polypeptide
  MOD_RES (11)..(11): Any amino acid
  MOD_RES (17)..(17): Any amino acid
EDTAVYYCARXGYGRYXYDVWGQGTLVTVS

SEQ ID NO: 6818 - protein, 30 aa, Artificial Sequence
  Description of Artificial Sequence: Synthetic polypeptide
  MOD_RES (11)..(11): Any amino acid
  MOD_RES (18)..(18): Any amino acid
EDTAVYYCARXGYGRYFXDVWGQGTLVTVS

SEQ ID NO: 6819 - protein, 30 aa, Artificial Sequence
  Description of Artificial Sequence: Synthetic polypeptide
  MOD_RES (11)..(11): Any amino acid
  MOD_RES (19)..(19): Any amino acid
EDTAVYYCARXGYGRYFYXVWGQGTLVTVS

SEQ ID NO: 6820 - protein, 30 aa, Artificial Sequence
  Description of Artificial Sequence: Synthetic polypeptide
  MOD_RES (11)..(11): Any amino acid
  MOD_RES (20)..(20): Any amino acid
EDTAVYYCARXGYGRYFYDXWGQGTLVTVS

SEQ ID NO: 6821 - protein, 30 aa, Artificial Sequence
  Description of Artificial Sequence: Synthetic polypeptide
  MOD_RES (12)..(13): Any amino acid
EDTAVYYCARDXXGRYFYDVWGQGTLVTVS

SEQ ID NO: 6822 - protein, 30 aa, Artificial Sequence
  Description of Artificial Sequence: Synthetic polypeptide
  MOD_RES (12)..(12): Any amino acid
  MOD_RES (14)..(14): Any amino acid
EDTAVYYCARDXYXRYFYDVWGQGTLVTVS

SEQ ID NO: 6823 - protein, 30 aa, Artificial Sequence
  Description of Artificial Sequence: Synthetic polypeptide
  MOD_RES (12)..(12): Any amino acid
  MOD_RES (15)..(15): Any amino acid
EDTAVYYCARDXYGXYFYDVWGQGTLVTVS

SEQ ID NO: 6824 - protein, 30 aa, Artificial Sequence
  Description of Artificial Sequence: Synthetic polypeptide
  MOD_RES (12)..(12): Any amino acid
  MOD_RES (16)..(16): Any amino acid
EDTAVYYCARDXYGRXFYDVWGQGTLVTVS

SEQ ID NO: 6825 - protein, 30 aa, Artificial Sequence
  Description of Artificial Sequence: Synthetic polypeptide
  MOD_RES (12)..(12): Any amino acid
  MOD_RES (17)..(17): Any amino acid
EDTAVYYCARDXYGRYXYDVWGQGTLVTVS

SEQ ID NO: 6826 - protein, 30 aa, Artificial Sequence
  Description of Artificial Sequence: Synthetic polypeptide
  MOD_RES (12)..(12): Any amino acid
  MOD_RES (18)..(18): Any amino acid
EDTAVYYCARDXYGRYFXDVWGQGTLVTVS

SEQ ID NO: 6827 - protein, 30 aa, Artificial Sequence
  Description of Artificial Sequence: Synthetic polypeptide
  MOD_RES (12)..(12): Any amino acid
  MOD_RES (19)..(19): Any amino acid
EDTAVYYCARDXYGRYFYXVWGQGTLVTVS

SEQ ID NO: 6828 - protein, 30 aa, Artificial Sequence
  Description of Artificial Sequence: Synthetic polypeptide
  MOD_RES (12)..(12): Any amino acid
  MOD_RES (20)..(20): Any amino acid
EDTAVYYCARDXYGRYFYDXWGQGTLVTVS

SEQ ID NO: 6829 - protein, 12 aa, Artificial Sequence
  Description of Artificial Sequence: Synthetic peptide
ARDGYGRYFYDV

SEQ ID NO: 6830 - protein, 12 aa, Artificial Sequence
  Description of Artificial Sequence: Synthetic peptide
GRDAYGRYFYDV

SEQ ID NO: 6831 - protein, 12 aa, Artificial Sequence
  Description of Artificial Sequence: Synthetic peptide
ARDAYGRYFYRV

SEQ ID NO: 6832 - protein, 12 aa, Artificial Sequence
  Description of Artificial Sequence: Synthetic peptide
PRDAYGRYFYDV

SEQ ID NO: 6833 - protein, 12 aa, Artificial Sequence
  Description of Artificial Sequence: Synthetic peptide
ARDAYGRYFYDG

SEQ ID NO: 6834 - protein, 12 aa, Artificial Sequence
  Description of Artificial Sequence: Synthetic peptide
ARDRYGAYFYDV

SEQ ID NO: 6835 - protein, 12 aa, Artificial Sequence
  Description of Artificial Sequence: Synthetic peptide
ARDRYGRYFYDV

SEQ ID NO: 6836 - protein, 12 aa, Artificial Sequence
  Description of Artificial Sequence: Synthetic peptide
ARDSYGRYFYDV

SEQ ID NO: 6837 - protein, 12 aa, Artificial Sequence
  Description of Artificial Sequence: Synthetic peptide
ARDVYGRYLYDV

SEQ ID NO: 6838 - protein, 12 aa, Artificial Sequence
  Description of Artificial Sequence: Synthetic peptide
ARDVLGRYFYDV

SEQ ID NO: 6839 - protein, 12 aa, Artificial Sequence
  Description of Artificial Sequence: Synthetic peptide
ARDQYGRYFYDV

SEQ ID NO: 6840 - protein, 12 aa, Artificial Sequence
  Description of Artificial Sequence: Synthetic peptide
ARDVYRRYFYDV

SEQ ID NO: 6841 - protein, 12 aa, Artificial Sequence
  Description of Artificial Sequence: Synthetic peptide
VRDLRGRYFYDV

SEQ ID NO: 6842 - protein, 12 aa, Artificial Sequence
  Description of Artificial Sequence: Synthetic peptide
ARDVYGRYFYDL

SEQ ID NO: 6843 - protein, 12 aa, Artificial Sequence
  Description of Artificial Sequence: Synthetic peptide
ARDAYGGYFYDV

SEQ ID NO: 6844 - protein, 12 aa, Artificial Sequence
  Description of Artificial Sequence: Synthetic peptide
ARDNYGGYFYDV

SEQ ID NO: 6845 - protein, 5 aa, Artificial Sequence
  Description of Artificial Sequence: Synthetic peptide
GGGGS

SEQ ID NO: 6846 - protein, 14 aa, Artificial Sequence
  Description of Artificial Sequence: Synthetic peptide
WVRQAPGQRLEWMG

SEQ ID NO: 6847 - protein, 10 aa, Artificial Sequence
  Description of Artificial Sequence: Synthetic peptide
FGGGTKVEIK

SEQ ID NO: 6848 - protein, 14 aa, Artificial Sequence
  Description of Artificial Sequence: Synthetic peptide
WVRQAPGQCLEWMG

SEQ ID NO: 6849 - protein, 10 aa, Artificial Sequence
  Description of Artificial Sequence: Synthetic peptide
FGCGTKVEIK

SEQ ID NO: 6850 - protein, 14 aa, Artificial Sequence
  Description of Artificial Sequence: Synthetic peptide
WVRQAPGGCLEWMG

SEQ ID NO: 6851 - protein, 10 aa, Artificial Sequence
  Description of Artificial Sequence: Synthetic peptide
FGCGTKVEIK

SEQ ID NO: 6852 - protein, 125 aa, Artificial Sequence
  Description of Artificial Sequence: Synthetic polypeptide
EVQLLESGGGLVQPGGSLRLSCAASGFTFNTYAMNWVRQAPGKGLEWVSRIRSKYNNYATYYADSVKDRFTISRDNSKNTLYLQMNSLRAEDTAVYYCVRHGNFGNSYVSWFAYWGQGTLVTVSS

SEQ ID NO: 6853 - protein, 125 aa, Artificial Sequence; identical to SEQ ID NO: 2
  Description of Artificial Sequence: Synthetic polypeptide

SEQ ID NO: 6854 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKDRFTISRDDSKNSLYLQMNSLKTEDTAVYYCVRHGNFGNSYVSWFAYWGQGTLVTVSS

SEQ ID NO: 6855 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSS

SEQ ID NO: 6856 - protein, 109 aa, Artificial Sequence
  Description of Artificial Sequence: Synthetic polypeptide
QTVVTQEPSFSVSPGGTVTLTCRSSTGAVTTSNYANWYQQTPGQAPRTLIYGTNKRAPGVPDRFSGSILGNKAALTITGAQADDESDYYCALWYSNLWVFGGGTKLTVL

SEQ ID NO: 6857 - protein, 109 aa, Artificial Sequence
  Description of Artificial Sequence: Synthetic polypeptide
QTVVTQEPSFSVSPGGTVTLTCRSSTGAVTTSNYANWYQQTPGQAPRTLIGGTNKRAPGVPDRFSGSILGNKAALTITGAQADDESDYYCALWYSNLWVFGGGTKLTVL

SEQ ID NO: 6858 - protein, 109 aa, Artificial Sequence; identical to SEQ ID NO: 10
  Description of Artificial Sequence: Synthetic polypeptide

SEQ ID NO: 6859 - protein, 109 aa, Artificial Sequence
  Description of Artificial Sequence: Synthetic polypeptide
QAVVTQEPSLTVSPGGTVTLTCRSSTGAVTTSNYANWFQQKPGQAPRTLIYGTNKRAPWTPARFSGSLLGGKAALTLSGAQPEDEAEYYCALWYSNLWVFGGGTKLTVL

SEQ ID NO: 6860 - protein, 109 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPGVPARFSGSLLGDKAALTLSGAQPEDEAEYYCALWYSNLWVFGGGTKLTVL

SEQ ID NO: 6861 - protein, 110 aa, Artificial Sequence
  Description of Artificial Sequence: Synthetic polypeptide
EIVMTQSPATLSVSPGERATLSCRSSTGAVTTSNYANWYQQKPGQAPRLLIYGTNKRAPGIPARFSGSGSGTEFTLTISSLQSEDFAVYYCALWYSNLWVFGGGTKVEIK

SEQ ID NO: 6862 - protein, 110 aa, Artificial Sequence
  Description of Artificial Sequence: Synthetic polypeptide
EIVVTQSPATLSVSPGERATLSCRSSTGAVTTSNYANWVQQKPGQAPRGLIGGTNKRAPGVPARFSGSGSGDEATLTISSLQSEDFAVYYCALWYSNLWVFGGGTKVEIK

SEQ ID NO: 6863 - protein, 109 aa, Artificial Sequence; identical to SEQ ID NO: 10
  Description of Artificial Sequence: Synthetic polypeptide

SEQ ID NO: 6864 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTNKRAPGVPDRFSGSLLGDKAALTITGAQADDESDYYCALWYSNRWVFGGGTKLTVL

SEQ ID NO: 6865 - protein, 109 aa, Artificial Sequence
  Description of Artificial Sequence: Synthetic polypeptide
QTVVTQEPSFSVSPGGTVTLTCGSSTGAVTTSNYANWVQQTPGQAPRGLIGGTNKRAPGVPDRFSGSLLGDKAALTITGAQADDESDYYCALWYSNRWVFGGGTKLTVL

SEQ ID NO: 6866 - protein, 109 aa, Artificial Sequence
  Description of Artificial Sequence: Synthetic polypeptide
QTVVTQEPSFSVSPGGTVTLTCRSSAGAVTTSNYANWVQQTPGQAPRGLIGGTNKRAPGVPDRFSGSLLGDKAALTITGAQADDESDYYCALWYSNRWVFGGGTKLTVL

SEQ ID NO: 6867 - protein, 109 aa, Artificial Sequence
  Description of Artificial Sequence: Synthetic polypeptide
QTVVTQEPSLSVSPGGTVTLTCRSSTGAVTTSNYANWVQQTPGQAPRGLIGGTNKRAPGVPDRFSGSLLGDKAALTITGAQADDESDYYCALWYSNRWVFGGGTKLTVL

SEQ ID NO: 6868 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTNKRAPGVPDRFSGSLLGDRAALTITGAQADDESDYYCALWYSNRWVFGGGTKLTVL

SEQ ID NO: 6869 - protein, 109 aa, Artificial Sequence
  Description of Artificial Sequence: Synthetic polypeptide
QAVVTQEPSFSVSPGGTVTLTCRSSTGAVTTSNYANWVQQTPGQAPRGLIGGTNKRAPGVPDRFSGSLLGDKAALTITGAQADDESDYYCALWYSNRWVFGGGTKLTVL

SEQ ID NO: 6870 - protein, 109 aa, Artificial Sequence
  Description of Artificial Sequence: Synthetic polypeptide
QAVVTQEPSFSVSPGGTVTLTCRSSIGAVTTSNYANWVQQTPGQAPRGLIGGTNKRAPGVPDRFSGSLLGDKAALTITGAQADDESDYYCALWYSNRWVFGGGTKLTVL

SEQ ID NO: 6871 - protein, 109 aa, Artificial Sequence
  Description of Artificial Sequence: Synthetic polypeptide
QTVVTQEPSFSVSPGGTVTLTCRSSTGAVTTGNYANWVQQTPGQAPRGLIGGTNKRAPGVPDRFSGSLLGDKAALTITGAQADDESDYYCALWYSNRWVFGGGTKLTVL

SEQ ID NO: 6872 - protein, 109 aa, Artificial Sequence
  Description of Artificial Sequence: Synthetic polypeptide
QTVVTQEPSFSVSPGGTVTLTCRSSTGAVTTSNYANWVQQAPGQTPRGLIGGTNKRAPGVPDRFSGSLLGDKAALTITGAQADDESDYYCALWYSNRWVFGGGTKLTVL

SEQ ID NO: 6873 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTSKRAPGVPDRFSGSLLGDKAALTITGAQADDESDYYCALWYSNRWVFGGGTKLTVL

SEQ ID NO: 6874 - protein, 109 aa, Artificial Sequence
  Description of Artificial Sequence: Synthetic polypeptide
QTVVTQEPSFSVSPGGTVTLTCGSSTGAVTTSNYANWVQQTPGQAPRGLIGGTNRRAPGVPDRFSGSLLGDKAALTITGAQADDESDYYCALWYSNLWVFGGGTKLTVL

SEQ ID NO: 6875 - protein, 109 aa, Artificial Sequence
  Description of Artificial Sequence: Synthetic polypeptide
QTVVTQEPSFSVSPGGTVTLTCRSSTGAVTTSNYANWVRQTPGQAPRGLIGGTNKRAPGVPDRFSGSLLGDKAALTITGAQADDESDYYCALWYSNRWVFGGGTKLTVL

SEQ ID NO: 6876 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTNKRAPGVPDRFSGSLLGDKAALIITGAQADDESDYYCALWYSNRWVFGGGTKLTVL

SEQ ID NO: 6877 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTNRRAPGVPDRFSGSLLGDKAALTITGAQADDESDYYCALWYNNLWVFGGGTKLTVL

SEQ ID NO: 6878 - protein, 109 aa, Artificial Sequence
  Description of Artificial Sequence: Synthetic polypeptide
QTVVTQEPSFSVSPGGTVTLTCKSSTGAVTTSNYANWVQQTPGQAPRGLIGGTNKRAPGVPDRFSGSLLGDKAALTITGAQADDESDYYCALWYSNRWVFGGGTKLTVL

SEQ ID NO: 6879 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTNKRAPGVPDRFSGSLLGDKAALTITGAQADDESDYYCALWYSNHWVFGGGTKLTVL

SEQ ID NO: 6880 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTNRRAPGVPDRFSGSLLGDKAALTITGAQADDESDYYCALWYSNRWVFGGGTKLTVL

SEQ ID NO: 6881 - protein, 125 aa, Artificial Sequence; identical to SEQ ID NO: 2
  Description of Artificial Sequence: Synthetic polypeptide

SEQ ID NO: 6882 - protein, 125 aa, Artificial Sequence
  Description of Artificial Sequence: Synthetic polypeptide
EVQLLESGGGLVQPGGSLRLSCAASGFTFNTYAMNWVRQAPGKGLEWVARIRSKYNNYATYYADSVKDRFTISRDDSKSTLYLQMNSLRAEDTAVYYCVRHDNFRNSYVSWFAYWGQGTLVTVSS

SEQ ID NO: 6883 - protein, 125 aa, Artificial Sequence; identical to SEQ ID NO: 82
  Description of Artificial Sequence: Synthetic polypeptide

SEQ ID NO: 6884 - protein, 125 aa, Artificial Sequence
  Description of Artificial Sequence: Synthetic polypeptide
EVQLLESGGGLVQPGGSLRLSCAASGFTFNTYAMNWVRQAPGKGLEWVARIRSKYNNYATYYADSVKDRFTISRDDSKSTLYLQMNSLRAEDTAVYYCVRHGNFGNSHVSWFAYWGQGTLVTVSS

SEQ ID NO: 6885 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVARIRSKYNDYATYYADSVKDRFTISRDDSKSTLYLQMNSLRAEDTAVYYCVRHGNFGNSHVSWFAYWGQGTLVTVSS

SEQ ID NO: 6886 - protein, 125 aa, Artificial Sequence
  Description of Artificial Sequence: Synthetic polypeptide
EVQLLESGGGLVQPGGSLRLSCAASGFTFNTYAMNWVRQAPGKGLEWVARIRSKYNNYATYYADSVKDRFTISRDDSKSTLYLQMNSLRAEDTAVYYCVRHGNFGNSYVSWFAHWGQGTLVTVSS

SEQ ID NO: 6887 - protein, 125 aa, Artificial Sequence
  Description of Artificial Sequence: Synthetic polypeptide
EVQLLESGGGLVQPGGSLRLSCAASGFTFDTYAMNWVRQAPGKGLEWVARIRSKYNNYATYYADSVKDRFTISRDDSKSTLYLQMNSLRAEDTAVYYCVRHGNFGNSYVSWFAYWGQGTLVTVSS

SEQ ID NO: 6888 - protein, 125 aa, Artificial Sequence
  Description of Artificial Sequence: Synthetic polypeptide
EVQLSESGGGLVQPGGSLRLSCAASGFTFNTYAMNWVRQAPGKGLEWVARIRSKYNNYATYYADSVKDRFTISRDDSKSTLYLQMNSLRAEDTAVYYCVRHGNFGNSYVSWFAYWGQGTLVTVSS

SEQ ID NO: 6889 - protein, 125 aa, Artificial Sequence
  Description of Artificial Sequence: Synthetic polypeptide
EVQLLESGGGLVQPGGSLRLSCAASGFTFNAYAMNWVRQAPGKGLEWVARIRSKYNNYATYYADSVKDRFTISRDDSKSTLYLQMNSLRAEDTAVYYCVRHGNFGNSYVSWFAYWGQGTLVTVSS

SEQ ID NO: 6890 - protein, 109 aa, Artificial Sequence; identical to SEQ ID NO: 10
  Description of Artificial Sequence: Synthetic polypeptide

SEQ ID NO: 6891 - protein, 109 aa, Artificial Sequence; identical to SEQ ID NO: 6864
  Description of Artificial Sequence: Synthetic polypeptide

SEQ ID NO: 6892 - protein, 109 aa, Artificial Sequence; identical to SEQ ID NO: 6866
  Description of Artificial Sequence: Synthetic polypeptide

SEQ ID NO: 6893 - protein, 109 aa, Artificial Sequence; identical to SEQ ID NO: 6867
  Description of Artificial Sequence: Synthetic polypeptide

SEQ ID NO: 6894 - protein, 109 aa, Artificial Sequence; identical to SEQ ID NO: 6865
  Description of Artificial Sequence: Synthetic polypeptide

SEQ ID NO: 6895 - protein, 109 aa, Artificial Sequence
  Description of Artificial Sequence: Synthetic polypeptide
QTVVTQEPSLSVSPGGTVTLTCRSSTGAVTTSNYANWVQQTPGQAPRGLIGGTNKRAPGVPDRFSGSLLGDKAALTITGAQADDESDYYCALWYNNLWVFGGGTKLTVL

SEQ ID NO: 6896 - protein, 109 aa, Artificial Sequence; identical to SEQ ID NO: 6870
  Description of Artificial Sequence: Synthetic polypeptide

SEQ ID NO: 6897 - protein, 109 aa, Artificial Sequence
  Description of Artificial Sequence: Synthetic polypeptide
QTVVTQEPSLSVSPGGTVTLTCRSSTGAVTTSNYANWVQQTPGQAPRGLIGGTNKRAPGVPDRFSGSLLGDKAALTITGAQADDESDYYCALWYSNLWVFGGGTKLTVL

SEQ ID NO: 6898 - protein, 109 aa, Artificial Sequence
  Description of Artificial Sequence: Synthetic polypeptide
QTVVTQEPSLSVSPGGTVTLTCGSSTGAVTTSNYANWVQQTPGQAPRGLIGGTNKRAPGVPDRFSGSLLGDKAALTITGAQADDESDYYCALWYSNLWVFGGGTKLTVL

SEQ ID NO: 6899 - protein, 109 aa, Artificial Sequence
  Description of Artificial Sequence: Synthetic polypeptide
QTVVTQEPSLSVSPGGTVTLTCRSSTGAVTTSNYANWVQQTPGQAPRGLIGGTNKRAPGVPDRFSGSLLGDKAALIITGAQADDEADYYCALWYSNLWVFGGGTKLTVL

SEQ ID NO: 6900 - protein, 109 aa, Artificial Sequence
  Description of Artificial Sequence: Synthetic polypeptide
RTVVTQEPSLSVSPGGTVTLTCRSSTGAVTTSNYANWVQQTPGQAPRGLIGGTNKRAPGVPDRFSGSLLGDKAALTITGAQADDESDYYCALWYNNLWVFGGGTKLTVL

SEQ ID NO: 6901 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTNKRAPGVPDRFSGSLLGDKAALTITGAQADDESDYYCALWYNNLWVFGGGTKLTVL

SEQ ID NO: 6902 - protein, 109 aa, Artificial Sequence
  Description of Artificial Sequence: Synthetic polypeptide
QTVVTQEPSFSVSPGGTVTLTCGSSTGAVTTSNYANWVQQTPGQAPRGLIGGTDKRAPGVPDRFSGSLLGGKAALTITGAQADDESDYYCALWYSNLWVFGGGTKLTVL

SEQ ID NO: 6903 - protein, 109 aa, Artificial Sequence
  Description of Artificial Sequence: Synthetic polypeptide
QPVVTQEPSFSVSPGGTVTLTCRSSTGAVTTSNYANWVQQTPGQAPRGLIGGTNKRAPGVPDRFSGSLLGDKAALTITGAQADDESDYYCALWYSNLWVFGGGTKLTVL

SEQ ID NO: 6904 - protein, 109 aa, Artificial Sequence; identical to SEQ ID NO: 6869
  Description of Artificial Sequence: Synthetic polypeptide

SEQ ID NO: 6905 - protein, 109 aa, Artificial Sequence
  Description of Artificial Sequence: Synthetic polypeptide
QTVVTQEPSFSVSPGGTVTLTCGSSTGAVTTSNYANWVQQTPGQAPRGLIGGTNKRAPGVPDRFSGSLLGDKAALTITGAQADDESDYYCALWYSNLWVFGGGTKLTVL

SEQ ID NO: 6906 - protein, 109 aa, Artificial Sequence
  Description of Artificial Sequence: Synthetic polypeptide
RTVVTQEPSFSVSPGGTVTLTCGSSTGAVTTSNYANWVQQTPGQAPRGLIGGTNKRAPGVPDRFSGSLLGDKAALIITGAQADDESDYYCALWYSNLWVFGGGTKLTVL

SEQ ID NO: 6907 - protein, 109 aa, Artificial Sequence
  Description of Artificial Sequence: Synthetic polypeptide
QTVVTQEPSLAVSPGGTVTLTCRSSTGAVTTSNYANWVQQTPGQAPRGLIGGTDQRAPGVPDRFSGSLLGDKATLTITGAQADDESDYYCALWYSNLWVFGGGTKLTVL

SEQ ID NO: 6908 - protein, 109 aa, Artificial Sequence
  Description of Artificial Sequence: Synthetic polypeptide
QAVVTQEQSFSVSPGGTVTLTCRSSIGAVTTSNYANWVQQTPGQAPRGLIGGTNKRAPGVPDRFSGSLLGDKAALTITGAQADDESDYYCALWYSNRWVFGGGTKLTVL

SEQ ID NO: 6909 - protein, 109 aa, Artificial Sequence
  Description of Artificial Sequence: Synthetic polypeptide
QTVVTQEPSLSVSPGGTVTLTCGPSTGAVTTSNYANWVQQTPGQAPRGLIGGTNKRAPGVPDRFSGSLLGDKAALTITGAQADDESDYYCALWYSNLWVFGGGTKLTVL

SEQ ID NO: 6910 - protein, 109 aa, Artificial Sequence
  Description of Artificial Sequence: Synthetic polypeptide
QTVVTQEPSFSVSPGGTVTLTCRSSTGAVTTSNYANWVQQAPGQAPRGLIGGTNQRAPGVPDRFSGSLLGDKAALTITGAQADDEADYYCALWYSNLWVFGGGTKLTVL

SEQ ID NO: 6911 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTNKRAPGVPDRFSGSLLGDKAALTITGVQADDESDYYCALWYSNRWVFGGGTKLTVL

SEQ ID NO: 6912 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTDKRAPGVPDRFSGSLLGDKAALTITGVQADDESDYYCALWYSNLWVFGGGTKLTVL

SEQ ID NO: 6913 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTNKRAPGVPDRFSGSLLGDKAVLTITGAQADDESDYYCALWYSNLWVFGGGTKLTVL

SEQ ID NO: 6914 - protein, 109 aa, Artificial Sequence
  Description of Artificial Sequence: Synthetic polypeptide
QTVVTQEPSFSVSPGGTVTLTCRSSTGAVTTSNYANWVQQTPGQAPRGLIGGTNKRAPGVPDRFSGSLLGDKAALTITGAQADDEADYYCALWYSNLWVFGGGTKLTVL

SEQ ID NO: 6915 - protein, 109 aa, Artificial Sequence
  Description of Artificial Sequence: Synthetic polypeptide
QTVVTQETSLSVSPGGTVTLTCRSSTGAVTTSNYANWVQQTPGQAPRGLIGGTDKRAPGVPDRFSGSLLGDKAALTITGAQAEDESDYYCALWYSNLWVFGGGTKLTVL

SEQ ID NO: 6916 - protein, 109 aa, Artificial Sequence; identical to SEQ ID NO: 6876
  Description of Artificial Sequence: Synthetic polypeptide

SEQ ID NO: 6917 - protein, 109 aa, Artificial Sequence
  Description of Artificial Sequence: Synthetic polypeptide
QTVVTQEPSFSVSPGGTVTLTCGSSAGAVTTSNYANWVQQTPGQAPRGLIGGTNKRAPGVPDRFSGSLLGDKAALTITGAQADDESDYYCALWYSNLWVFGGGTKLTVL

SEQ ID NO: 6918 - protein, 109 aa, Artificial Sequence; identical to SEQ ID NO: 42
  Description of Artificial Sequence: Synthetic polypeptide

SEQ ID NO: 6919 - protein, 109 aa, Artificial Sequence
  Description of Artificial Sequence: Synthetic polypeptide
QPVVTQEPSFSVSPGGTVTLTCRSSTGAVTASNYANWVQQAPGQAPRGLIGGTNQRAPGVPDRFSGSLLGDKAALTITGAQADDESDYYCALWYNNLWVFGGGTKLTVL

SEQ ID NO: 6920 - protein, 109 aa, Artificial Sequence; identical to SEQ ID NO: 26
  Description of Artificial Sequence: Synthetic polypeptide

SEQ ID NO: 6921 - protein, 109 aa, Artificial Sequence
  Description of Artificial Sequence: Synthetic polypeptide
QTVVTQEPSLSVSPGGTVTLTCRSSTGAVTTSNYANWVQQTPGQAPRGLIGGTNKRAPGVPDRFSGSLLGDKAALTITGAQADDEADYYCALWYNNLWVFGGGTKLTVL

SEQ ID NO: 6922 - protein, 125 aa, Artificial Sequence; identical to SEQ ID NO: 2
  Description of Artificial Sequence: Synthetic polypeptide

SEQ ID NO: 6923 - protein, 125 aa, Artificial Sequence; identical to SEQ ID NO: 6887
  Description of Artificial Sequence: Synthetic polypeptide

SEQ ID NO: 6924 - protein, 125 aa, Artificial Sequence
  Description of Artificial Sequence: Synthetic polypeptide
EVQLLESGGGLVQPGGSLRLSCAASGFTFNTYAMNWVRQAPGKGLEWVARIRSKYNNYATYYADSVKDRFTISRDDSKSTLYLQMNSLRAEDTAVYYCVRHGNFGNSYISWFAYWGQGTLVTVSS

SEQ ID NO: 6925 - protein, 125 aa, Artificial Sequence
  Description of Artificial Sequence: Synthetic polypeptide
EVQLSESGGGLVQPGGSLRLSCAASGFTFSTYAMNWVRQAPGKGLEWVARIRSKYNNYATYYADSVKDRFTISRDDSKSTLYLQMNSLRAEDTAVYYCVRHGNFGNSYVSWFAYWGQGTLVTVSS

SEQ ID NO: 6926 - protein, 125 aa, Artificial Sequence
  Description of Artificial Sequence: Synthetic polypeptide
EVQLLESGGGLVQPGGSLRLSCAASGFTFNTYAMNWVRQAPGKGLEWVARIRSKYNNYATYYADSVKDRFTISRDDSKSTLYLQMNSLRAEDTAVYYCVRHSNFGNSYVSWFAYWGQGTLVTVSS

SEQ ID NO: 6927 - protein, 125 aa, Artificial Sequence
  Description of Artificial Sequence: Synthetic polypeptide
EVQLLESGGGLVQPGGSLRLSCAASGFTFNTYAMNWVRQAPGKGLEWIARIRSKYNNYATYYADSVKDRFTISRDDSKSTLYLQMNSLRAEDTAVYYCVRHGNFGNSYVSWFAYWGQGTLVTVSS

SEQ ID NO: 6928 - protein, 125 aa, Artificial Sequence
  Description of Artificial Sequence: Synthetic polypeptide
EVQLLESGGGLVQPGGSLRLSCAASGFTFNTYAMNWVRQAPGKGLEWVARIRSKYNNYATYYADSVKDRFTISRDDSKSTLYLQMDSLRAEDTAVYYCVRHGNFGNSYVSWFAYWGQGTLVTVSS

SEQ ID NO: 6929 - protein, 125 aa, Artificial Sequence
  Description of Artificial Sequence: Synthetic polypeptide
EVQLLESGGGLVQPGGSLRLSCAASGFTFNTYAMNWVRQAPGKGLEWVARIRSKYNDYATYYADSVKDRFTISRDDSKSTLYLQMNSLRAEDTAVYYCVRHGNFGNSYVSWFAYWGQGTLVTVSS

SEQ ID NO: 6930 - protein, 125 aa, Artificial Sequence
  Description of Artificial Sequence: Synthetic polypeptide
EVQLLESGGGLVQPGGSLRLSCAASGFTFDTYAMNWVRQAPGKGLEWVARIRSKYNNYATYYADSVKDRFTISRNDSKSTLYLQMNSLRAEDTAVYYCVRHGNFGNSYVSWFAYWGQGTLVTVSS

SEQ ID NO: 6931 - protein, 125 aa, Artificial Sequence
  Description of Artificial Sequence: Synthetic polypeptide
EVQLLESGGGLVQPGGSLRLSCAASGFTFNTYAMNWVRQAPGKGLEWVARIRSKYNNYATYYADSVKDRFTISRDDSKSTLYLQMNSLRAEDTAVYYCVRHGNFGNSSVSWFAYWGQGTLVTVSS

SEQ ID NO: 6932 - protein, 125 aa, Artificial Sequence; identical to SEQ ID NO: 6884
  Description of Artificial Sequence: Synthetic polypeptide

SEQ ID NO: 6933 - protein, 109 aa, Artificial Sequence; identical to SEQ ID NO: 10
  Description of Artificial Sequence: Synthetic polypeptide

SEQ ID NO: 6934 - protein, 109 aa, Artificial Sequence; identical to SEQ ID NO: 1674
  Description of Artificial Sequence: Synthetic polypeptide

SEQ ID NO: 6935 - protein, 109 aa, Artificial Sequence; identical to SEQ ID NO: 2298
  Description of Artificial Sequence: Synthetic polypeptide

SEQ ID NO: 6936 - protein, 109 aa, Artificial Sequence; identical to SEQ ID NO: 362
  Description of Artificial Sequence: Synthetic polypeptide

SEQ ID NO: 6937 - protein, 109 aa, Artificial Sequence; identical to SEQ ID NO: 1690
  Description of Artificial Sequence: Synthetic polypeptide

SEQ ID NO: 6938 - protein, 109 aa, Artificial Sequence; identical to SEQ ID NO: 2314
  Description of Artificial Sequence: Synthetic polypeptide

SEQ ID NO: 6939 - protein, 109 aa, Artificial Sequence; identical to SEQ ID NO: 1706
  Description of Artificial Sequence: Synthetic polypeptide

SEQ ID NO: 6940 - protein, 109 aa, Artificial Sequence; identical to SEQ ID NO: 202
  Description of Artificial Sequence: Synthetic polypeptide

SEQ ID NO: 6941 - protein, 109 aa, Artificial Sequence; identical to SEQ ID NO: 1722
  Description of Artificial Sequence: Synthetic polypeptide

SEQ ID NO: 6942 - protein, 109 aa, Artificial Sequence; identical to SEQ ID NO: 1738
  Description of Artificial Sequence: Synthetic polypeptide

SEQ ID NO: 6943 - protein, 109 aa, Artificial Sequence; identical to SEQ ID NO: 1754
  Description of Artificial Sequence: Synthetic polypeptide

SEQ ID NO: 6944 - protein, 109 aa, Artificial Sequence; identical to SEQ ID NO: 1770
  Description of Artificial Sequence: Synthetic polypeptide

SEQ ID NO: 6945 - protein, 109 aa, Artificial Sequence; identical to SEQ ID NO: 1786
  Description of Artificial Sequence: Synthetic polypeptide

SEQ ID NO: 6946 - protein, 109 aa, Artificial Sequence; identical to SEQ ID NO: 218
  Description of Artificial Sequence: Synthetic polypeptide

SEQ ID NO: 6947 - protein, 109 aa, Artificial Sequence; identical to SEQ ID NO: 1802
  Description of Artificial Sequence: Synthetic polypeptide

SEQ ID NO: 6948 - protein, 109 aa, Artificial Sequence; identical to SEQ ID NO: 2506
  Description of Artificial Sequence: Synthetic polypeptide

SEQ ID NO: 6949 - protein, 109 aa, Artificial Sequence; identical to SEQ ID NO: 378
  Description of Artificial Sequence: Synthetic polypeptide

SEQ ID NO: 6950 - protein, 109 aa, Artificial Sequence; identical to SEQ ID NO: 234
  Description of Artificial Sequence: Synthetic polypeptide

SEQ ID NO: 6951 - protein, 109 aa, Artificial Sequence; identical to SEQ ID NO: 250
  Description of Artificial Sequence: Synthetic polypeptide

SEQ ID NO: 6952 - protein, 109 aa, Artificial Sequence; identical to SEQ ID NO: 1258
  Description of Artificial Sequence: Synthetic polypeptide

SEQ ID NO: 6953 - protein, 109 aa, Artificial Sequence; identical to SEQ ID NO: 2410
  Description of Artificial Sequence: Synthetic polypeptide

SEQ ID NO: 6954 - protein, 109 aa, Artificial Sequence; identical to SEQ ID NO: 330
  Description of Artificial Sequence: Synthetic polypeptide

SEQ ID NO: 6955 - protein, 109 aa, Artificial Sequence; identical to SEQ ID NO: 346
  Description of Artificial Sequence: Synthetic polypeptide

SEQ ID NO: 6956 - protein, 109 aa, Artificial Sequence; identical to SEQ ID NO: 1818
  Description of Artificial Sequence: Synthetic polypeptide

SEQ ID NO: 6957 - protein, 109 aa, Artificial Sequence; identical to SEQ ID NO: 2330
  Description of Artificial Sequence: Synthetic polypeptide

SEQ ID NO: 6958 - protein, 109 aa, Artificial Sequence; identical to SEQ ID NO: 266
  Description of Artificial Sequence: Synthetic polypeptide

SEQ ID NO: 6959 - protein, 109 aa, Artificial Sequence; identical to SEQ ID NO: 1834
  Description of Artificial Sequence: Synthetic polypeptide

SEQ ID NO: 6960 - protein, 109 aa, Artificial Sequence; identical to SEQ ID NO: 2426
  Description of Artificial Sequence: Synthetic polypeptide

SEQ ID NO: 6961 - protein, 109 aa, Artificial Sequence; identical to SEQ ID NO: 2282
  Description of Artificial Sequence: Synthetic polypeptide

SEQ ID NO: 6962 - protein, 30 aa, Artificial Sequence
  Description of Artificial Sequence: Synthetic polypeptide
RFTISRDDSKSTLYLQMNSLRAEDTAVYYC

SEQ ID NO: 6963 - protein, 16 aa, Artificial Sequence
  Description of Artificial Sequence: Synthetic peptide
VRHGNFGNGYVSWFAH

SEQ ID NO: 6964 - protein, 30 aa, Artificial Sequence
  Description of Artificial Sequence: Synthetic polypeptide
RFTISRDDSKSTLYLQMESLRAEDTAVYYC

SEQ ID NO: 6965 - protein, 16 aa, Artificial Sequence
  Description of Artificial Sequence: Synthetic peptide
VRHGNFGNGYVSWFAH

SEQ ID NO: 6966 - protein, 30 aa, Artificial Sequence; identical to SEQ ID NO: 6962
  Description of Artificial Sequence: Synthetic polypeptide

SEQ ID NO: 6967 - protein, 16 aa, Artificial Sequence
  Description of Artificial Sequence: Synthetic peptide
VRHGNFGNEYVSWFAH

SEQ ID NO: 6968 - protein, 30 aa, Artificial Sequence
  Description of Artificial Sequence: Synthetic polypeptide
RFTISRDDSKSTLYLQMNALRAEDTAVYYC

SEQ ID NO: 6969 - protein, 16 aa, Artificial Sequence
  Description of Artificial Sequence: Synthetic peptide
VRHGNFGNGYVSWFAH

SEQ ID NO: 6970 - protein, 30 aa, Artificial Sequence; identical to SEQ ID NO: 6962
  Description of Artificial Sequence: Synthetic polypeptide

SEQ ID NO: 6971 - protein, 16 aa, Artificial Sequence
  Description of Artificial Sequence: Synthetic peptide
VRHGNFGNAYVSWFAH

SEQ ID NO: 6972 - protein, 30 aa, Artificial Sequence
  Description of Artificial Sequence: Synthetic polypeptide
DTAVYYCVRHGNFGNGYVSWFAHWGQGTLV

SEQ ID NO: 6973 - protein, 30 aa, Artificial Sequence
  Description of Artificial Sequence: Synthetic polypeptide
  MOD_RES (8)..(8): Any amino acid
  MOD_RES (15)..(15): Any amino acid
DTAVYYCXRHGNFGXGYVSWFAHWGQGTLV

SEQ ID NO: 6974 - protein, 30 aa, Artificial Sequence
  Description of Artificial Sequence: Synthetic polypeptide
  MOD_RES (8)..(8): Any amino acid
  MOD_RES (16)..(16): Any amino acid
DTAVYYCXRHGNFGNXYVSWFAHWGQGTLV

SEQ ID NO: 6975 - protein, 30 aa, Artificial Sequence
  Description of Artificial Sequence: Synthetic polypeptide
  MOD_RES (9)..(9): Any amino acid
  MOD_RES (15)..(15): Any amino acid
DTAVYYCVXHGNFGXGYVSWFAHWGQGTLV

SEQ ID NO: 6976 - protein, 30 aa, Artificial Sequence
  Description of Artificial Sequence: Synthetic polypeptide
  MOD_RES (9)..(9): Any amino acid
  MOD_RES (16)..(16): Any amino acid
DTAVYYCVXHGNFGNXYVSWFAHWGQGTLV

SEQ ID NO: 6977 - protein, 30 aa, Artificial Sequence
  Description of Artificial Sequence: Synthetic polypeptide
  MOD_RES (10)..(10): Any amino acid
  MOD_RES (15)..(15): Any amino acid
DTAVYYCVRXGNFGXGYVSWFAHWGQGTLV

SEQ ID NO: 6978 - protein, 30 aa, Artificial Sequence
  Description of Artificial Sequence: Synthetic polypeptide
  MOD_RES (10)..(10): Any amino acid
  MOD_RES (16)..(16): Any amino acid
DTAVYYCVRXGNFGNXYVSWFAHWGQGTLV

SEQ ID NO: 6979 - protein, 30 aa, Artificial Sequence
  Description of Artificial Sequence: Synthetic polypeptide
  MOD_RES (11)..(11): Any amino acid
  MOD_RES (15)..(15): Any amino acid
DTAVYYCVRHXNFGXGYVSWFAHWGQGTLV

SEQ ID NO: 6980 - protein, 30 aa, Artificial Sequence
  Description of Artificial Sequence: Synthetic polypeptide
  MOD_RES (11)..(11): Any amino acid
  MOD_RES (16)..(16): Any amino acid
DTAVYYCVRHXNFGNXYVSWFAHWGQGTLV

SEQ ID NO: 6981 - protein, 30 aa, Artificial Sequence
  Description of Artificial Sequence: Synthetic polypeptide
  MOD_RES (12)..(12): Any amino acid
  MOD_RES (15)..(15): Any amino acid
DTAVYYCVRHGXFGXGYVSWFAHWGQGTLV

SEQ ID NO: 6982 - protein, 30 aa, Artificial Sequence
  Description of Artificial Sequence: Synthetic polypeptide
  MOD_RES (12)..(12): Any amino acid
  MOD_RES (16)..(16): Any amino acid
DTAVYYCVRHGXFGNXYVSWFAHWGQGTLV

SEQ ID NO: 6983 - protein, 30 aa, Artificial Sequence
  Description of Artificial Sequence: Synthetic polypeptide
  MOD_RES (13)..(13): Any amino acid
  MOD_RES (15)..(15): Any amino acid
DTAVYYCVRHGNXGXGYVSWFAHWGQGTLV

SEQ ID NO: 6984 - protein, 30 aa, Artificial Sequence
  Description of Artificial Sequence: Synthetic polypeptide
  MOD_RES (13)..(13): Any amino acid
  MOD_RES (16)..(16): Any amino acid
DTAVYYCVRHGNXGNXYVSWFAHWGQGTLV

SEQ ID NO: 6985 - protein, 30 aa, Artificial Sequence
  Description of Artificial Sequence: Synthetic polypeptide
  MOD_RES (14)..(15): Any amino acid
DTAVYYCVRHGNFXXGYVSWFAHWGQGTLV

SEQ ID NO: 6986 - protein, 30 aa, Artificial Sequence
  Description of Artificial Sequence: Synthetic polypeptide
  MOD_RES (14)..(14): Any amino acid
  MOD_RES (16)..(16): Any amino acid
DTAVYYCVRHGNFXNXYVSWFAHWGQGTLV

SEQ ID NO: 6987 - protein, 30 aa, Artificial Sequence
  Description of Artificial Sequence: Synthetic polypeptide
  MOD_RES (15)..(16): Any amino acid
DTAVYYCVRHGNFGXXYVSWFAHWGQGTLV

SEQ ID NO: 6988 - protein, 30 aa, Artificial Sequence
  Description of Artificial Sequence: Synthetic polypeptide
  MOD_RES (15)..(15): Any amino acid
  MOD_RES (17)..(17): Any amino acid
DTAVYYCVRHGNFGXGXVSWFAHWGQGTLV

SEQ ID NO: 6989 - protein, 30 aa, Artificial Sequence
  Description of Artificial Sequence: Synthetic polypeptide
  MOD_RES (15)..(15): Any amino acid
  MOD_RES (18)..(18): Any amino acid
DTAVYYCVRHGNFGXGYXSWFAHWGQGTLV

SEQ ID NO: 6990 - protein, 30 aa, Artificial Sequence
  Description of Artificial Sequence: Synthetic polypeptide
  MOD_RES (15)..(15): Any amino acid
  MOD_RES (19)..(19): Any amino acid
DTAVYYCVRHGNFGXGYVXWFAHWGQGTLV

SEQ ID NO: 6991 - protein, 30 aa, Artificial Sequence
  Description of Artificial Sequence: Synthetic polypeptide
  MOD_RES (15)..(15): Any amino acid
  MOD_RES (20)..(20): Any amino acid
DTAVYYCVRHGNFGXGYVSXFAHWGQGTLV

SEQ ID NO: 6992 - protein, 30 aa, Artificial Sequence
  Description of Artificial Sequence: Synthetic polypeptide
  MOD_RES (15)..(15): Any amino acid
  MOD_RES (21)..(21): Any amino acid
DTAVYYCVRHGNFGXGYVSWXAHWGQGTLV

SEQ ID NO: 6993 - protein, 30 aa, Artificial Sequence
  Description of Artificial Sequence: Synthetic polypeptide
  MOD_RES (15)..(15): Any amino acid
  MOD_RES (22)..(22): Any amino acid
DTAVYYCVRHGNFGXGYVSWFXHWGQGTLV

SEQ ID NO: 6994 - protein, 30 aa, Artificial Sequence
  Description of Artificial Sequence: Synthetic polypeptide
  MOD_RES (15)..(15): Any amino acid
  MOD_RES (23)..(23): Any amino acid
DTAVYYCVRHGNFGXGYVSWFAXWGQGTLV

SEQ ID NO: 6995 - protein, 30 aa, Artificial Sequence
  Description of Artificial Sequence: Synthetic polypeptide
  MOD_RES (16)..(17): Any amino acid
DTAVYYCVRHGNFGNXXVSWFAHWGQGTLV

SEQ ID NO: 6996 - protein, 30 aa, Artificial Sequence
  Description of Artificial Sequence: Synthetic polypeptide
  MOD_RES (16)..(16): Any amino acid
  MOD_RES (18)..(18): Any amino acid
DTAVYYCVRHGNFGNXYXSWFAHWGQGTLV

SEQ ID NO: 6997 - protein, 30 aa, Artificial Sequence
  Description of Artificial Sequence: Synthetic polypeptide
  MOD_RES (16)..(16): Any amino acid
  MOD_RES (19)..(19): Any amino acid
DTAVYYCVRHGNFGNXYVXWFAHWGQGTLV

SEQ ID NO: 6998 - protein, 30 aa, Artificial Sequence
  Description of Artificial Sequence: Synthetic polypeptide
  MOD_RES (16)..(16): Any amino acid
  MOD_RES (20)..(20): Any amino acid
DTAVYYCVRHGNFGNXYVSXFAHWGQGTLV

SEQ ID NO: 6999 - protein, 30 aa, Artificial Sequence
  Description of Artificial Sequence: Synthetic polypeptide
  MOD_RES (16)..(16): Any amino acid
  MOD_RES (21)..(21): Any amino acid
DTAVYYCVRHGNFGNXYVSWXAHWGQGTLV

SEQ ID NO: 7000 - protein, 30 aa, Artificial Sequence
  Description of Artificial Sequence: Synthetic polypeptide
  MOD_RES (16)..(16): Any amino acid
  MOD_RES (22)..(22): Any amino acid
DTAVYYCVRHGNFGNXYVSWFXHWGQGTLV

SEQ ID NO: 7001 - protein, 30 aa, Artificial Sequence
  Description of Artificial Sequence: Synthetic polypeptide
  MOD_RES (16)..(16): Any amino acid
  MOD_RES (23)..(23): Any amino acid
DTAVYYCVRHGNFGNXYVSWFAXWGQGTLV

SEQ ID NO: 7002 - protein, 16 aa, Artificial Sequence
  Description of Artificial Sequence: Synthetic peptide
VRHGNFGNGYVSWFAH

SEQ ID NO: 7003 - protein, 16 aa, Artificial Sequence
  Description of Artificial Sequence: Synthetic peptide
VRHGNFGGGYVSWFAH

SEQ ID NO: 7004 - protein, 16 aa, Artificial Sequence
  Description of Artificial Sequence: Synthetic peptide
VRHGNFGNSYVSWFAH

SEQ ID NO: 7005 - protein, 16 aa, Artificial Sequence
  Description of Artificial Sequence: Synthetic peptide
VRHGNFGGGYVAWFAH

SEQ ID NO: 7006 - protein, 16 aa, Artificial Sequence
  Description of Artificial Sequence: Synthetic peptide
VRHGNFQGGYVSWFAH

SEQ ID NO: 7007 - protein, 16 aa, Artificial Sequence
  Description of Artificial Sequence: Synthetic peptide
VRHGNVGGGYVSWFAH

SEQ ID NO: 7008 - protein, 16 aa, Artificial Sequence
  Description of Artificial Sequence: Synthetic peptide
VRHDNFGAGYVSWFAH

SEQ ID NO: 7009 - protein, 16 aa, Artificial Sequence
  Description of Artificial Sequence: Synthetic peptide
VRHGNFGVGYVSWFAS

SEQ ID NO: 7010 - protein, 16 aa, Artificial Sequence
  Description of Artificial Sequence: Synthetic peptide
VRHGNFGNYAVSWFAH

SEQ ID NO: 7011 - protein, 16 aa, Artificial Sequence
  Description of Artificial Sequence: Synthetic peptide
VRHGSFGNHIVSWFAH

SEQ ID NO: 7012 - protein, 12 aa, Artificial Sequence
  Description of Artificial Sequence: Synthetic peptide
ARDGYSRYYFDY

SEQ ID NO: 7013 - protein, 12 aa, Artificial Sequence
  Description of Artificial Sequence: Synthetic peptide
ARDGYGRYFYDV

SEQ ID NO: 7014 - protein, 12 aa, Artificial Sequence
  Description of Artificial Sequence: Synthetic peptide
ARDAYGRYFYDV

SEQ ID NO: 7015 - protein, 12 aa, Artificial Sequence
  Description of Artificial Sequence: Synthetic peptide
GRDAYGRYFYDV

SEQ ID NO: 7016 - protein, 12 aa, Artificial Sequence
  Description of Artificial Sequence: Synthetic peptide
ARDAYGRYFYDV

SEQ ID NO: 7017 - protein, 12 aa, Artificial Sequence
  Description of Artificial Sequence: Synthetic peptide
ARDRYGAYFYDV

SEQ ID NO: 7018 - protein, 12 aa, Artificial Sequence
  Description of Artificial Sequence: Synthetic peptide
ARDQYGRYFYDV

SEQ ID NO: 7019 - protein, 12 aa, Artificial Sequence
  Description of Artificial Sequence: Synthetic peptide
ARDVLGRYFYDV

SEQ ID NO: 7020 - protein, 12 aa, Artificial Sequence
  Description of Artificial Sequence: Synthetic peptide
ARDAYGRYFYDV

SEQ ID NO: 7021 - protein, 12 aa, Artificial Sequence
  Description of Artificial Sequence: Synthetic peptide
GRDAYGRYFYDV

SEQ ID NO: 7022 - protein, 12 aa, Artificial Sequence
  Description of Artificial Sequence: Synthetic peptide
ARDAYGRYFYDV

SEQ ID NO: 7023 - protein, 12 aa, Artificial Sequence
  Description of Artificial Sequence: Synthetic peptide
ARDAYGGYFYDV

SEQ ID NO: 7024 - protein, 12 aa, Artificial Sequence
  Description of Artificial Sequence: Synthetic peptide
ARDNYGGYFYDV

SEQ ID NO: 7025 - protein, 16 aa, Artificial Sequence
  Description of Artificial Sequence: Synthetic peptide
VRHGNFGNSYISYWAY

SEQ ID NO: 7026 - protein, 16 aa, Artificial Sequence
  Description of Artificial Sequence: Synthetic peptide
VRHGNFGNGYVSWFAH

SEQ ID NO: 7027 - protein, 16 aa, Artificial Sequence
  Description of Artificial Sequence: Synthetic peptide
VRHGNFQGGYVSWFAH

SEQ ID NO: 7028 - protein, 16 aa, Artificial Sequence
  Description of Artificial Sequence: Synthetic peptide
VRHGNFGGGYVSWFAW

SEQ ID NO: 7029 - protein, 16 aa, Artificial Sequence
  Description of Artificial Sequence: Synthetic peptide
VRHGNFGEGYVSWFAH

SEQ ID NO: 7030 - protein, 16 aa, Artificial Sequence
  Description of Artificial Sequence: Synthetic peptide
VRHGNFGGAYVSWFAH

SEQ ID NO: 7031 - protein, 16 aa, Artificial Sequence
  Description of Artificial Sequence: Synthetic peptide
VRHGNFGGGYVSWFAW

SEQ ID NO: 7032 - protein, 16 aa, Artificial Sequence
  Description of Artificial Sequence: Synthetic peptide
VRHGNVGGGYVSWFAH

SEQ ID NO: 7033 - protein, 13 aa, Artificial Sequence
  Description of Artificial Sequence: Synthetic peptide
GRDWDGAIRVLDY

SEQ ID NO: 7034 - protein, 16 aa, Artificial Sequence
  Description of Artificial Sequence: Synthetic peptide
VRHGNFGNSYVSWFAY

What is claimed is:

1. An anti-cluster of differentiation three ("CD3") antibody or antibody fragment, which comprises:
   (A) a heavy chain variable region (VH) comprising a CDRH1, a CDRH2, and a CDRH3; and
   (B) a light chain variable region (VL) comprising a CDRL1, a CDRL2, and a CDRL3, wherein:
   the CDRH1, CDRH2, CDRH3, CDRL1, CDRL2, and CDRL3 comprise the amino acid sequences of SEQ ID NOS: 5187, 5189, 5191, 5195, 5197, and 5199, respectively.

2. An isolated or recombinant nucleic acid encoding an antibody or antibody fragment according to claim 1.

3. An expression vector comprising the isolated or recombinant nucleic acid according to claim 2.

4. A host cell transfected, transformed, or transduced with the isolated or recombinant nucleic acid according to claim 2 or a vector containing said nucleic acid.

5. A pharmaceutical composition comprising: (i) the anti-CD3 antibody or antibody fragment according claim 1; and (ii) a pharmaceutically acceptable carrier and/or excipient.

6. The antibody or antibody fragment according to claim 1, wherein:
   (A) the VH comprises an amino acid sequence that possesses at least 90% sequence identity to SEQ ID NO: 5186; and/or
   (B) the VL comprises an amino acid sequence that possesses at least 90% sequence identity to SEQ ID NO: 5194.

7. The antibody or antibody fragment according to claim 1, wherein:
   (A) the VH comprises an amino acid sequence that possesses at least 95% sequence identity to SEQ ID NO: 5186; and/or
   (B) the VL comprises an amino acid sequence that possesses at least 95% sequence identity to SEQ ID NO: 5194.

8. The antibody or antibody fragment according to claim 1, wherein:
   (A) the VH comprises the amino acid sequence of SEQ ID NO: 5186; and/or
   (B) the VL comprises the amino acid sequence of SEQ ID NO: 5194.

9. The antibody or antibody fragment according to claim 1, wherein:
   (A) the VH consists of the amino acid sequence of SEQ ID NO: 5186; and
   (B) the VL consists of the amino acid sequence of SEQ ID NO: 5194.

10. The anti-CD3 antibody or antibody fragment according to claim 1, which does not form a succinimide intermediate as determined by size exclusion chromatography (SEC) peak breadth.

11. The anti-CD3 antibody or antibody fragment according to claim 1, which comprises a multispecific antibody.

12. The anti-CD3 antibody or antibody fragment according to claim 1, which comprises a bispecific antibody.

13. The anti-CD3 antibody or antibody fragment according to claim 11 which comprises a multispecific format selected from the group consisting of: Fab-Fc-scFv, "bottle-opener, Mab-scFv, Mab-Fv, Dual scFv, central Fv, central scFv, one-arm central scFv, Fab-Fab, Fab-Fv, mAb-Fv, mAb-Fab, DART, BiTE, common light chain-IgG, TandAb, Cross-Mab, SEED, BEAT, TrioMab, and DuetMab.

14. A pharmaceutical composition comprising: (a) an anti-CD3 antibody or antibody fragment; and (b) a pharmaceutically acceptable carrier and/or excipient wherein said anti-CD3 antibody or antibody fragment is selected from the following:
   (i) the VH of the anti-CD3 antibody or antibody fragment comprises an amino acid sequence that possesses at least 90% sequence identity to SEQ ID NO: 5186; and the VL of the anti-CD3 antibody or antibody fragment comprises an amino acid sequence that possesses at least 90% sequence identity to SEQ ID NO: 5194;
   (ii) the VH of the anti-CD3 antibody or antibody fragment comprises an amino acid sequence that possesses at least 95% sequence identity to SEQ ID NO: 5186; and the VL of the anti-CD3 antibody or antibody fragment comprises an amino acid sequence that possesses at least 95% sequence identity to SEQ ID NO: 5194;
   (iii) the VH of the anti-CD3 antibody or antibody fragment comprises an amino acid sequence that is identical to SEQ ID NO: 5186; and the VL of the anti-CD3 antibody or antibody fragment comprises an amino acid sequence that is identical to SEQ ID NO: 5194; and wherein the heavy and light chain variable regions of said anti-CD3 antibody or antibody fragment of (i), (ii) or (iii) respectively comprise VH and VL CDRs according to claim 1.

15. A pharmaceutical composition comprising: (a) an anti-CD3 antibody or antibody fragment; and (b) a pharmaceutically acceptable carrier and/or excipient according to claim 14 wherein the VH of the anti-CD3 antibody or antibody fragment comprises an amino acid sequence that is identical to SEQ ID NO: 5186; and the VL of the anti-CD3 antibody or antibody fragment comprises an amino acid sequence that is identical to SEQ ID NO: 5194.

16. An isolated or recombinant nucleic acid encoding an anti-CD3 antibody or antibody fragment or a vector comprising said nucleic acid wherein said encoded anti-CD3 antibody or antibody fragment is selected from the following:
   (i) the VH of the anti-CD3 antibody or antibody fragment comprises an amino acid sequence that possesses at least 90% sequence identity to SEQ ID NO: 5186; and/or the VL of the anti-CD3 antibody or antibody fragment comprises an amino acid sequence that possesses at least 90% sequence identity to SEQ ID NO: 5194;
   (ii) the VH of the anti-CD3 antibody or antibody fragment comprises an amino acid sequence that possesses at least 95% sequence identity to SEQ ID NO: 5186; and/or the VL of the anti-CD3 antibody or antibody fragment comprises an amino acid sequence that possesses at least 95% sequence identity to SEQ ID NO: 5194; or
   (iii) the VH of the anti-CD3 antibody or antibody fragment comprises an amino acid sequence that is identical to SEQ ID NO: 5186; and/or the VL of the anti-CD3 antibody or antibody fragment comprises an amino acid sequence that is identical to SEQ ID NO: 5194; and wherein the heavy and light chain variable regions of the anti-CD3 antibody or antibody fragment of (i), (ii) or (iii) encoded by said nucleic acid respectively comprise VH and VL CDRs according to claim 1.

17. An isolated or recombinant nucleic acid encoding an anti-CD3 antibody or antibody fragment or a vector comprising said nucleic acid according to claim 16 wherein the VH of the anti-CD3 antibody or antibody fragment comprises an amino acid sequence that is identical to SEQ ID NO: 5186; and the VL of the anti-CD3 antibody or antibody fragment comprises an amino acid sequence that is identical to SEQ ID NO: 5194.

18. A host cell transfected, transformed, or transduced with an isolated or recombinant nucleic acid according to claim 16 or an expression vector containing said nucleic acid.

19. A host cell transfected, transformed, or transduced with an isolated or recombinant nucleic acid according to claim 17 or an expression vector containing said nucleic acid.

* * * * *